United States Patent 12,746,261 (PROBIOTIC BACILLUS COMPOSITIONS AND METHODS OF USE) - sequence listing, part 14

SEQ ID NO: 261 - DNA, 4063573 bp, Bacillus amyloliquefaciens (residues 2,031,788-4,063,573 of 4,063,573)
ttttcacttgtttatgcaatcggaacgcctgtcatgatggcccttacagcaaaactggacagaaggaagctcatgatctatgctcttggattgtttgtaatcggaaatatcatttcatttcttgtacagggatacggcttatttgcggcagcccgggtgatcatggcgcttggagcaggaactgtggtggtcaccgcgcttacgatcgcagcaaaaatcgctcccccgggaaaacaggcaagttctctcgcgaccgtcattatggggtttacggcggcgctcattatcggtgttccgatcggaagaaccgtgtctgaagcttttggctggaaggtggttttcgccggaattgcggcaatcggaatcattgccatgcttattatacgttttgcgttgcctgagataaaaggagataaaccggtgccgcttattcagcaattttctcttttgaagaaacgaaaggtggctgtcgggcttgctattacgtttttttggctcggaggctattcggttgcgtatacgtacctttctccgtatttactgaacgtcactcatatcggcagcggaatactgagtacattgctgcttattttcggtgttgctagtcttgccggttctaaagcaggcggtttcagtgctgacaaatggggggcgcgtatgacattaaccggcggaatggcgcttcatgctatcatgctcatgttattgccgtttgtcacacattctgctttcggagcggcggcagtgcttattttttggtccttcgccgcctggtcatcaggacctgctcagcagtatcatttggcaacgatggagcctgaatcatcgggtgtattacttggcctcaaccagtctgtgatgcagctggctatggcggccggggcgggcatcgggggcattgttgtcactcatctgtctcttgcgtcagtgacatggatcggatcagcgggtgttgtcatcgcgatgtgcggcgtgctttcacttgcctcgttaacatctgaaaaaccctcatctgaatacagtgcagaataaacaaaagcctcatttctcagcttgagaaacgaggctttttgcctagttattttttatattgtttcaagtttacgccgattgcggctccgtttcggcttgagtcggcaactccggtaaaggtgccgttttcacgatcgatcaggatgctttgcacattaccgatatcaaccgggctgctgccgaatttatgccccatttcgttcagttttgtgcgggcttcttccggcactcctttttcatatctataggatgtcatgctgtttgtgtaaattctcggctcttcgaccgccgctttcagatccatgccgtactcgactttgttcaggatcgtttgcaggacggaagaaataatcgttgctccgccgggagagccgacagtcaggacaggttcgttatttttgaataaaatagtcggagtcatgctgctgagcggacgtttattcggctgcacttcatttgcgccgccaggcaccgcatcgaagtctgttaactcattattcaacacaacgccgtatccgggaaccataatgccggaaccgaacagctgttcaatcgttgtcgtataagatacgacattgccgaagcggtcggttaccgtgaagtgggtcgtttggccttcttgtttgtcagtcggctgcttcacttgtttatagtttgcagaaccttcctgataggcccaagggtcgccggctttcggttttttattgactttatcaatatctatcagctgtctgcgggcattgatataatctggattcaagaggcctttgagagggacgttgacgaattctggatccccggcaaatgcggcgcggtcagcataagccaaatgcatcgtttctgcgagaagctgatatttttgccaagaacggatatcatattgagaaagcttaaaatcatccagaaggttcagcatttgcaacaggaaaacaccgcccgagcttggaggaggagcagttgcgatatgatagccctggtaatccccccagatcggttcgtcaatcgtcacattgaagtttttgatatctttttctgtcattgagccgccgaattcctgcactgtttccgcaagctttttggagaatgcaccgtcatagaatgcttttgtgcctttgtacttaatagctgtaaatgttttggctaagtctttttggatgagtgtgtctccttctttcagaggttctccgtccggaagaaacacgtcttttgcagcggtgtgtgataatttgtttttataatctgagatggcatcagctaaaaccgaatcgatcggaaagccttttgaggcaagtttaatggaaggggtgatgagttgtttcatggagcgtgtgccccatttgtcgagcgctttttcaagtccttttaatgttcccggaacaccgactgcagtccctttagtaacgcgttcggagaaagggatggctttgccgttttcgtcaaggaacatatccggtgctgcgcctgccggtgcgcgttcccggctgtcgataatggtggtgtctttcgtcttcgcatcataaaccatcataaatccgccgccgccgattcccgacatcataggttcagttacgtttaatgcgaattgaatggcgaccgcggcgtcaattgcattgcctccttttttcagcacgtcggcaccgatttgtgaagcgagaggatgggcggtggcaaccatgccgtctttgccgacatctacctgtttgtagtcgtcataggaaaacgggtgtttcttagcctgagcgtgataagggatgcttccggccgtgagcaaagtactgagcagaacgataaaacagagattcataaactttttctttttcatagtctgcctcctttgttttccgcttacaattatagagtaagtaaaatgtgctgttttcacaagtgacaaacggaatagtccggtgcgcaaaaagccggagtttctgtgtgaatgtaatcagtcgcaaataggctaaatgggaaaccgggcagaaaaagctgtgaaacaagcataaagacaaaaaataagctacaataaacaaaacagaattcactcacatgacatatgaaaggaacgtgagccatgtatttaacgatcaaagagacagctgagtttaccagtcttcctgaagaatatgtgcacaatcttgttttgacgaataaaataagggccgtacatgacggacagcaatatttaatcaacaaggaacaatttcaaacccatctcgaacagctggaaaaatataaggaaatgattcaagagtttttaaatgagccgcttcctgaagacattgatgtaaaagatgaagactaggacacaatttcatattgtgtctttttttttcatttttttcggttgctcacaaaaaaacgaatgctcagatttcgttttaagggcgttgtttttcttttttaataccgtgagtctctgttgatttaaaatcccgtcatcgggtcgaaaatgatgttttgaagacttcgatgaaactgcgtgccttattccccttatgtaacactatgtatattatgttacataaggccctttatcctttatcattcaacaggtttcggctataatagtaacataatgctcaatatgttactttaccaattataaggggttttttgatgcatatcgtacagccgatccgaagtttggagaagatccaggaagtcaaacagtatttaatgaagaaaagtgatcgtgattattttttatttattttcggcatgaacagcgcactgcggatttctgatgttctgccgcttcgcgtgagggatgtaaggaacaaagaccatgtgtgggcaaccgaaagcaaaacgagaaagaaaagaaaaattctgatactggagtctttgaaggccgacatatacgcttatacaaaagacatgaaagaggatgactatttgtttaaatcgaaacggacgaataagcccatttcccggattcaggcatacagaatattaaaggaagcagctgccgcgtgcggattggaggaaatcgggacgcatacgcttagaaagacgttcgggtatcatttttatcagaggacaaaagacattgctgaactgcagaggattttgaatcattcttctccgtctattacaatgcgttatatcggaatagatgaagatacgacgagagccgcctataaagtgttcggagggctgtaggcttgaaaaaaacggccgccagcgttactataatagaagcaggctctagtagcacagcggatagtgcagcagtttcctaaactgcaggtcgggagttcgaatctctcctagagcgttttcgacataagataggtgcggattaataatgtcggcaagacagaaaaccccttgttatacaaggggtttttgagtttaatattttgcaagaacctggtggaaatgatgtgaaaaaagcccgctgtaagcaagcgggctttttcttatatgacagcatcaaattgattgactttccaaacgttgttttcttttacgaatgttacatcgcgttttgctgacggtgaaccgtcaagagtcggtacagtgaagcggtatgtttgaacgcttccttttttagaaagaagagtcatttttgcttttttccaattcaggaggttatctccgtcgccgagcggaacagccaatttgccgtcttttacagtgaagtggtaatctttgagccctttgtcaatcgcttgctttgtaaaagcgggtgtcagatattttacggctttcgcttttgttccgaggtctttgcacataaagacgtattgaagattttgatattcaaacggttcagatgtgcagtttgcgtttgatttaagcgcaccgccgctcatcgtgttccagaaatgttctctcgctgacagggccagctgaagtgcttgtttttgtgtaaggtcattaggtgcattttttgcggtcgccgcagtgcccaatgacagaatcaatgtaatagtagtgaggaataatagccattttttcatgatataatctctccttcaatcaatctctttctcttatgttacaaatgttacaataattacgataagattacaataccttttcagaaatattttccggactttttatttttatggtttatttccatgtaagacgtgagaataagataaagagtttcattgaacaaaaggtttttacaagctgtctgctgaataataaaatggaagaaaatcaaaaaaggagtcctacatatggaagtacaagatcatttagaaacagcggaaggccgcggccagtctgtctggcgatcgatgtcactgtttttagtgccgctgcttttaagcaatgtattgcaatctgtcggccaattggtcggaatggtatttgtcggaaggtggctcggagttgatgcgcttgccgccgtatcgtctttttttccgctgttttttctgctgatctcctttacgatcggaatcggttcgggaagttccattctgatcgggcaggcttacggcgcgaaaaacgaagagaggatgaaggcgattgtcggcactacactgacttttacctttatgctcggtgttgttctggcagttgtcggcagtgtgtttacgcttgatattctgcggctgatgggaacgccggaaaacgtaatagatgtcagtgtccgatatgcgcgtattttgttttgcgcaatgccgctgatgtttttatattttgcgtatacgacatttttacgcggaacgggagattcaaagactccgttttatacgttaatcgtcagtacagtcataaacatcggtctcttgcccttattgattctcgggcttttcggacttccgaagttcggcatttacggttcggcgtatgcaaccgtgatttcaaacatcgtgacatttatcgtactcatggtttatttgcggaaaaggaaacatccattggcatttgaccggactgcgctccgttctcttaaaatggacaaaaagctgctcgcgcttttactccgtctcggtattccgtcaagcatcaatatgattctcgtatcactttctgaaattgcggtcatttcatttgtcaatcattacggatcaaacgcgacggctgcttacggggtcgtcaaccaagtggcgagttatgtgcagatgccggcggtaagcctcggtatcgccgtttcaatttttgccgcccaatccattggcgccaatcaattcggccggctgaagcaggtcatcaaagtcggcatcggcctgaattatttgatcggcggggttttgattgtgctgatttacaccttctcccggcagatactggctttgtttttaaccgatcaggatacactccgcattgcccgcaatctgattatgattaccctttggagctatctgattttcggtcacgctcagattgtttcagcaacaatgcgggcgagcggtacggtgttatggccgacgattatcagcatttttacgatttggggaattgaagtgcctgtggcctttattctttctcattatacgaatctcggcattctcggcatttgggtcggttatccggcggcttttgtcgtcagcctgctgctgcaatacggatattaccggtttgtatggaagaaaaaacagattacccggctgattcaataaggttttaccgcacatcgctcagttcatacgggcgatgttttttttagagaaggaaaatgagtttagaaaatggaattcctatacatgctagaaaacaaggaaagggcaggtgcttatgacgattgaacatacgacttatttaggagtttcagccataaaggcggagactgatcaggctgaatgcatcattgtgccggagtggggatcaaatgtcatatcgcttcgggataaaagaaccggtatgcggcttctgagagaaccggaaactgcggaggaattcctcaaaaaaccgatgctgtacggcattcccgttttattcccgccgaaccggattacggacgggacgtttcgttttgacggccgctcgtatcaattcgagataaacgaagaggataaacataatcatattcacggctttcttcacaatcagcattggaaagcggcagcagcgaaagaagagggggatggaatgacagtcgaaacagaaattgatctttcaaagattccccgtgttcataaacaatttccgcacgatgtcattgtccggatgacctatacattaaaagacaatgtgtttacgcagcgggcgctgattatgaataagggaacggaggcttttccttgggggctaggctatcattccacatttgttttcaatgaagagcaatcccgtctatttttgacggctgaccgcatgtgggaattaaatgaacgtttcgtaccgacgggccgtttattggatgttcctgataaagaagcgttccgtcatgggatgtctttgaaaaataaacagtttgacgatgtttttctttcttccggacggaatggcggcaataacgaagctgttatttatcatccgaatgagaaattatccgttttgtatcaggcagacacgtctttcaagcattgggtggtatataacggtgacggaaagcaggggtttgtcagtcttgagccttatacttccgttacagatgcatttaatctgaatcagcctgcatcactgacagggcttcagattctgaaaccgggcgaagaagcggctgcgtcatccgggatcaccattttgcatgacgaagaataggaaagaggcgggataacattgaaaacatatgtgaaacgcttgtgcgcggtgattctgcttttgatcattgccgaagttccttatattgatgatgcggctaaggcggctgaacaaaaaaatactttgcaaaaagagctggaacacattctggatgaagaacccgctttaaagggggcttcagcgggcatcattgtccggtcagcaaaaacaggggaggtgctgttcggcagccgggaagatatgcggctgaggcctgcatcattgatgaaactgctgacggcatctgcggcgctttccgttctcggagaagattacacctttaagacagaagtacgggcagacggcgccgtgaaaggaaaacagctgcgcggaaacctttatctcaggggaaaaggcgatccgaccctattggcttctgattttgagaagatggctaaacaggtcaaagccagaggcatccatgtcattaaaggagatctggtcggggatgattcgtggtatgacgataccaggtattcagttgatcttccgtggagtgatgaaggccaatattatggcgcgcaagtatcagctcttaccgcttccccaaatgaggattatgataccggaacggtgattgcggaaatcagcccggcgaaacagcccgataaaaagccgcgcatttcaatttctccctatacggacatcgttcgtgtgaaaaatgaagtaaaaaccgtcgcttctgatgaaaagaaagaattgacggttgaacgggagcacggtggcaatgtgattacgataaagggagccatacctgccggctcggcaaaggcaagagaatgggcggcagtgtgggatccgtcgtcctatgctttagatttatggaaacaagcgcttactaaacagggtgtaactgtaaaagggaaaatcagaacaggccgaatgccgcaccgcacccagcttgtcacatcacggacatccatgcctctttcagaattattgatcccgtttatgaaactgagcaacaacgggcacgccgaaattctgatcaaggaaatgggaaaagtgaaaaaaggggagggcagctgggaaaagggcttggacgtgatgaaatcggagctcaaatcgttcgggctcaatccggatgaattgattgcaagagacggatccggcgtttctcatattaacggcgtatccgccggccaaatcggagagcttttgtatgcggttcagaaagagaagtggtacccggctttccttcgttcgctccctgtcgccggtgcaagcgacagaatgacgggaggcactcttcggaaccggctgaagaatactccggcagagggcaaaattaaagcaaaaaccgggtcactaacatcagtcagttcgattgccggctatgcagacacaaaaacaggagatacgcttattttttccgtgcttcaaaacgggctgcttgacgaagatgacggaaaagacattgaagacaaaatcgcagtcgtgctggcaaatcaataagaagggccggatccttagagggttcggcttttttgatgtctgtaaaacattatattgcgattatgaatcaatcttttcaaaaagtaatatcggcaacattcttccttttttttacatgatactttcttacttgttcactgatttttcattttttatcataaaatttcttttcggaaagcaaaacctttttaaaagcgcaattaattatacattttattccttattatagtgttttagaaccagtttgcagtgtacatacatactgttttacatggtataaaaattatagaaatgaagaagtgaagtgaggaatatatactatattctaaaaaatgttagaaaaaatttaattttttattgtgatttctaaaatatgttttaaaataatgcttatatggatgatttagtcatatgctgtcgaaatttaattgtaattatttcactttcttatcctcttaaattgaaatggagggattccattgaagaacactgtttattctttaactcacgcccaaagaagagtctggtttacagagctgctcgagccgggcacaagtatctgcaatcttgcggcgtgcgtcaaattcagggggaatatcgactttgacgtattgcgccgtgctttagatttctctatcttgcaaaatgattcgctcaggtttcaactgacggaaggggacggctcagaaccccagctgtatctggccgggcatcggccgatttctttagagaccgttgattttactcatattgatcaatcagagcgggatgcatggattgacaaacagacgcgtgttccgttcaagctgtttcattcaccgctgtatcattttactctgcttgtcatgtcagacgaagaagtttggctttattcaaaatttcaccatattattatggacggcatctcgctcaatctgcttggcaatcagctcattgaaatctaccaaaaaatcatgcgaagcgaggatttggccgaacaccaaagcccttcctatctcagctacatggaaaaagaacagcaatacctacagtcttcccgttttcaaaaagaccgttcattttggactgaaacataccgaaccgttccggaacacctttcactggcggaacgaacctctcatcttagacaaagcactgcagcttcaagagatacaatcactctttcccactccttagaacaatcaatccggcgtttttgcaaagatcataatgtcagcatcatctctctgtttatggcttcgttatacatatgcatcagccgtctgacggctaaaaaggatattgccatcggtacttattacggaaaccgcggttccaagctcgaaaaggatatgctcggcatgttcgtcagcacgctaccgatcagaatgacggcagatccggatgcggagttcgtgtcttttgtccgcagtgtaggaaaacagcagctgtctgttatgcggcaccagaaatatccttacaatctttttgtcaatgaattaaggcagattcatcacgacctgcaaaatatcatcgggatttcgatgcaataccagcctctcgcgtggcgtcaggcagaaggtttcgattatgaaacggcgatgtttttcagcgggcatacggcaaatgagctgtccattttaattaaggagcggacagatacgggattgattgagctgaattttgattatcaatccgctttatttactaaaacatcgattaaacgaattcaaactcatttgctgacgatcgttgaaaatgccgttagaaatccaaaccggctgattcggcatattgatatggcggatgaaaaagaaaagaaacgggtgttaactgcgtttaaccatacagaaacggctgaaccgccggccccgacgcttcacgggctgtttgcccgccgcgccgcgctttcgccgcatcgtccggcgctccgttttccgggcggtatgctgacgtacgctgagcttgaccagtacacagacaggctcgccgttcggctccgccaaaaaggcatccgcaaagaaagcatggtcggcgtactcgctgaacgctcgccggagatggcggtttcagtgcttgccgtgttaaaagcgggcggcgcctacgtgccgcttgacccggagtatcctgaggacaggctgcgatatatgcttgaggacagcggcgcttgtctcctgcttgcacagccggggttatccgtttccggtttttccggtgaaacgctagaagtgtctctttcttctctgacaaatgagacggagacaggggctgtctctgaagaagcggatgctgattcgctcgcttatatcatttatacgtccggttcgacgggaacaccgaagggagtggctgttgaacaccgtcaagccgccgcctttttatcagggatgcaagggcagtttccgttaacggaagaggatattatcgtgctgaaatcatccttttcattcgacgcctccatctggcaattgttttggtggacgatgtccggcgcctccgtgtatctgcttccggccggctgggagaaagatcctgtgcggatgattgaagcgtttgcctcagaaaaggtgacgaccgcgcattttattccggcgatggtcaacagctttttagacgcgctggaaacagagcctgcggaaacaagaacacgcctcggcagaacactgacacgcgtgttcgccggaggggaagctctttccccgcttacggctgcccggtttgccgatcttctgccggagaccatgcttattcacggctatggaccgacggaagcgacggttgatgcggcgttttacgtctgtgaccgaaaacgggacagcggacggacaaggcttccgatcggaaaacccgttccgggtgcccgtctgtatgtattagatagcggaggaaccatccagcctgcgggcgtggcaggagagctgtacatcgcggggaccggcgtggcccggggctatctgaaccgccctgagctgacggaggagcgctttgtcgttgatccgttttatccgggagaacgcatgtatcagacgggcgatatcgcacgctggacagaagacggccttgtcgaatggctcggtcgttcagacggacaggtgaaagtccgcggctaccggattgaaccgggggaaatcgaagcggcgatccggcacatcgacggcattcgtgaggcggcggtcaccgcccggaccgaacacggcgaaaccgcgctttacgcctatattgaaggacgaaaaagcgatgacgtgcgggcggagcttgcgacacgccttccggcctacatgatgccggctcagtttatagagatgagcgaatggccggtcacgccaagcggaaagcttgaccgccgcgcgctgccggctcccggcggatcggcagacagacaggcgtacactgccccgcggaacgtcacggaaatgaagctttgcgccctttgggaagaggtgctgaaaaacggccccgtcggcatccgggatcacttttttgagcggggcggccattcgttaaaagcgacggctctcgtctcccgcatcgccaaagagttcggtgttcaggtgccgttacaggacatcttcgcccggccgacggtggaagagctcgcttcggttattcaggacttggaagaaagctcgtatgaagcgattcagcctgcgcaaacacaagatacctacccggtgtcttcagcgcagaaacggatgtatgtgctccaacagcttgaagacggcggtgtcggctacaatatgccggctgtgctggaactgacgggcccgcttgaccgtgtccggctggaggagacgttccggcagcttgtggagcggcacgagtcgctcagaacgtcctttgaaacggggcctgacggcgaaccggtgcagcgcatccatgacagcgtgccgtttcagctcgatgaggccgagtcagctgacgcattcgtccggccgttttgtctggaggaagcgccgctcttccgtgcggccctcgtgaaagaatcggaagaacaccatcttttattaacggatatgcatcatattatttctgacggtgtgtccgtcaacaccttgataaaagaattcggcgagctgtacgcaggccgttcgcttgcgccgatgcgccttcaatataaagactatgccgtctggcagcggtcgtttcaggagaaagaaggatatcagaagcaggaagcctattggctgaagcggcttgaaggagagcttccggtgcttgaacttccggctgacaagccccgtccggcggtcagaagctttgcgggcggcagcgtatcgtgcacgcttgacgctgacacggcatccggccttcaccgcatcgcccgggatcacggctccactttgtatatggtgcttctcgccgcgtacaatacgctgctcgcgcgattgagcgggcaggaagacatcatcgtcggatcgccgattgccgggcgcccgcacaaagaccttgaaccgattctcgggatgttcgtcaacacgcttgccatcagaacggagccgaagggggacaaacggttcaccgattatttggcggaagtccgccaggcggcgcttgaggcgtatgaacatcaggactacccgtttgaagagcttgtggagcggctcggcgtgcagcgggacatgagccgcaatccgctgtttgatgtgatgtttattcttcagaatatggagcgggaggagataaatctggccggtctgaaggcgtcacgatcaaagcataccgaacatgatgtatcaagttttgacctgaccttatcagcggctgaatccgatggaaacatccgctttgagatggaattcagcaccgagctttttatgaaagaaacgattgaacgctggatgggccacttactgaatctcttgcgccatgttgccgccgaaccggaagtcacactatcgaaagctgacattttggatgaagaagaaaaacaaaagttactgattgagtttaataacacacaaaccgaattcatggaaaaacacaaactgtttcaccagctgtttgaagagaaagcagaagaaacgcctcatcagaccgctgttattgaaggagcacaacagatcagctatttccagctcaatgagcgggcaaaccgtcttgcccgaacactgcagaaaaatggattcggtccgggaaaaagagcagccatattagcaaaccgttcgattgaagcgatcgtcagtgttcttgcggtcatgaaatcaggaggagcgtatataccggttgactcccattatcctgaggaacggattcgctatttattaaaagacagcgcggcatccgtcttgatggtgcagtcagaatacaaagaacttgcttcacagctgacggatcacaatttatttctcattcagcttgatcatgaagatcaatacgatatttccgcaaagaatattcagccgacagcgtcaccggatgataccgcatatatcatatatacttcgggaacaacgggaacgccgaagggagtcgaagtcagaaatcgcagctttacgcatgcagcacttgcatggcgcaggatttatgagcttgatcttataccggtcagagtgctgcagatggcgagtttctcatttgatgtattttcaggggatctagcacgcgccctgctaaacgggggaacgcttgtcatttgtccggatgacgtccggcttgagccgcagcagctttatcggctcattgatcagcaccgtatcacgtttatggagtcgacacccgcgctgattgttccgtttatggaatatatataccgccggaaactcgcgctgcaaagcgtaaaaatactggtacttggttcagatatgatcaagtcgcaagatttttatacgcttcatgaacgctttgggaaagaaatgcggatcattaacagctacggtgtaacagaagcgacaattgactcttcgtattatgaagccgaaatgagcgaagagccgcgggaagatgatgtgccgatcggtgttccgcttccgaatgtgcaaatgtacgtcttaaacaaagacaaacaggtccagccgatcggcgttttcggagagctgtatatcggaggcgccggcgtcgccaaaggatattggggacagcctgagctgacagaggacgcattcagtgacccgttacaaacgggagaaacgctttacagaaccggagatcaggcttgctggctgccggatggaactcttcgttttaaagggcggatcgataagcaggtgaagatcagaggctacagaattgagacgggagaaatagaaagtgtgcttttgaaacacgatcaagtcaaagaagcggctgttaccgtgatgaaagatgccgaaggacaagcacgattagcggcatacgtcgttcctaaagaggccgatatctcatcactccgccagtctcttatgcaggagctcccggcttatatgatgccgtctcatattatcggtttagacagcatgccccttacactgaacggcaaacttgataaatcggcattgccggcagaagagatacattcatcacaggcatttgtcgcgcccggcgatgaaaaacaggcgatgttatgccggatttgggaagatgtgcttcatattcagaaagcgggaattcatcactctttctttgagcttgggggagattccattaaggcgcttcaagtgtcagcccgactcgccggagaaggctggaacatgtcgatccgcgatttgtttcagttcccgacgattgcagaactcgcgaagcacctcacgccggctgttgcaacggctgatcagggcccgatagaaggaagcgctccgctgacaccgatccagcagagattttttgaggagccgggtgcgtttgagcttcattataaccaatcagtcatgctgtgcagtgaagacagcctcgaaatagatgcgctgtatcaggcggtttgcgcgctgacagaacatcatgatgcgctgcgaatgactttcactgaaaatgagcatggggaagttgttcaatataaccgcggaatcacagagcagcatgaagaaatctttacgcttaacgtcatagatctttcagaagaaacacagccggaaaaacggatagccgctgaggaaaaagaaatacagcaggctatgcgccttgatcaaggccctctgcttcatctcggagtgttcaggctgaaagaagccgaccatctgctcatcacgattcatcaccttatcacggacggcgtgtcgtggagaatattgcttgaagatctgcagacagcatatcagcaggcattggacggcaaacaaatcgaactgccgccgaaaagcgattcttatataaagtatgccgaagagctttttgacatttccaagagcaaagcattgctggaggaagccgcatactgggacagcgtgatgtctggtgaaacagcgccgctgccgaaaataactgatgaaaacgccggacgattgcaggaaaacgcgcgcactgcatcatggatattaagcagcgaagtcacgaagcagctgctgatggaaacacagcaggcgtacggaacggatgttcatgaattgcttttaacggcgcttggaatgacgcttcatgagtggacgggttccgaacagatccttatcagcactgaaggacacggacgccaggggcatattcctgacattgatatgtcaagaacggcgggctggtttacatctgtttacccggtgcttttggatatgagagtgccggacggctcaggggaaacaaccgcgcaccgcataaagacggtaaaagacatgatgagacgggttcctcatcacggaaccggctacgggctgctgagatattcgcgaaacattctttataaagacccagaaataagctttaactatctcggtgcgtttgacggtcttgaggggacgctgaagatgtcaccgttcaagccgcagcatgatatagcggccgggcgcatccgcgagtttgatctggatattaacgcgatggtggcggccgggcaactggaggtaaaagccgtttataccgatgtatttgcaccgggggcaatcgagttcttcatgaatcgtttccatactcacctcggggacatcatcgcccactgttccggcaagaaagagcgggaaaaaacattaacggattacagccatacagaattgaccgctcaagccctatcaagcattgaagatctcgtaaaaggactttaatttcataaaaaggtgtgtggcattcgtgacacaagcgacagaaattcaagatatttaccctttatcatatatgcaggaaggcatgctgtttcattcgcttctggattccggatcaaacgcatatgttgagcagatttcgtttacagtcagcggggatttatgcattgatacattccaaaaaagtctggatatgcttgtcagccgttatgatattttcagaacgattttcataaaagaagtgcctgaccttgaagggccgcagcaggttgtcctttcacgccgtgacactgccgtacggactgaagacatttcagattattcggaagaacggcagcaaagcatcattgacaaattcaaggaaaccgaccggcataaggggtttgatctgcaaaaaggccccttaatgcgcctgactctttttcaaacgggagaaaaccgccatacgtgcgtttggactcatcatcacattatgatggacggctggagcttgggccttgtactgaaagatttcttcagcatgtattatgcgatccggagcgggcggcctgtaaacctcggcagtccggctccttacagcacttatatcaaatggctccgaagccggaataaagaagaaacgtcagcattctggtcgcgctgcttggaagattacggagaaaccgtttccgttccgcaaacgaagaataagacggcgcaaaacggttatgcatctgagcatttccaattttcccttgagcctgaaaccgtacaaaaactgacagacattgcccgaggcatcggggtcacgctgaatactatatttacgggcatttggggtctgcttctccatcgttacaacgggactgaagatgccgtcttcggttcggttgtttccggcaggccttcagctatcagcggcattgaatccatggccggactgtttatcaataccgtgccggtaagggtgcgcgcggctggtgatatgactttttcttctcttctcaaaaaggtgcaaaaagagtcactcgctgcggaagagcacagctattatccgctttatgacattcaaaacgagagcggcctgcaaaaagatctcttgaatcacatcctggtttttgaaaattatccggttcagatgcaggctgcggtaaacggctggcagcaaacggaaagccatgcgctctcacttgaaaacttttcgatggcggaggaaaccaattacgatcttaacgtcgtcatcgttccgggagaagagttttatgtgaaattcagctacaatgcgggcatctacgatcgggaagacatgaaacggatcaaagggcatattctagaggtcatctcctgtgtaacggaagatccggacaggcttttatcaagcatcagtctcgtaccaccggaggaagaagccctgattcattcgtttaacgaaacgaaccgtccgtaccctgagacaaccgttcatgggctgtttgaagaacaggcggcaaaaacgcctgaccaagaggcgttgagatataacggggtaagctggagctacaagaaattaaatcagcgggcaaatcagattgcccatgcgttaagggaaaaaggcgcccgttcagatcagatcaccgctgttatgctgcgccgatcaatgagtacggttgccgctctgctcggaatttggaagtcgggcagcgcctatatgccgattgatgcggaatttccgcctgaacggatttcatttttactgagagacagtgaagcctcactgctcctgactgaaaaagacctgctccccctcattccgccgcatttcaaggggagcgtcgtcatcatggaggaaacggtttcccagcagactgcaccgcttccgccggtgtctgacagcggaaattgggcgtatgtcatttacacttccggaacgacaggccggccgaaaggggtgcttgtacaacacaaagcgatcagcaatacattgcaatggcggcgtgaagaatacgggatgacagaaggagacatagcgcttcatcttttttcatacgtatttgacgggtcattaacgagtcttttcactccgcttctgtcgggcgcctgtgtactgttaactgatgaagatgatgcgaaagacgtcctttcaataaaacagaaaatcgcccgccacggggtaagccatcttctgatcgttccgtctctgtatcgcgttctgcttgattcgctgacgaaaaaggatgcgcagacgcttcgggcggtgacatttgccggggaagcggccactcctgatatcgtggaagcgagccgcaacatatgcccgaatgccgagctgctgaatgaatacggcccgacggaaaacagtgtggccacgacgattctgcgcaacctgcaaaaaagcagccggattacgatcgggcgcccgattgccaacacttctgtctatatgatgcacggagatcggctgcaaccggtcggagccgtcggtgaactgtgtatttccggaaaaggtctggcggacggatattttcagcaaaaagagctgacggacaaagtctttacccctcatccgtttcgtaaaggtgaacggctgtacagaacgggagatgcagcccgatttttaccggacggaacgattgaatatatgggacgctttgacgatcaggtgaaggtaagaggttacagaattgaattaggagaaatcgaaacggcactcagaagtctgtccggggtaaaagaggcggcagtcatcgtgcgcaaaacggcggacggggaacaggagcttgcagcttatgccgtactggaaaacgcgggtgtgacatttgatcctcatgccgaattggccgggagattacctgcttatatgatcccgggaagctttaccaaattgacggaaatgccgctgtctgtgagcggaaaacttgaccgggccgcacttcctgagccgaaagaagccgagagaaccggtgattatcaagctccgcgcacaatgcttgagactgagctgctgtctatttggcaagaagtgctgaaacgggaacacatcagtatgagagatgatttcttccaaatcggcggacagtcgctgaaagccgcgtcgcttgtttcaaagatacataaacggctgcaaattgaacttgccgtccgccatgtttttgaacatccgaccatcgagagcatggcccgcttcctagaacagaggaaaagaggagaatatgcagaaatcacgcctgcggaggcaaaggacttgtacccgctatcttttgcgcaaaaaaggctttatgcccttcatcagcttgcggcggacagtacgggctatcatatgcccgcttgtctggaactgagcggcagactcaaccgtgatcgtctgcacgaagccttttcagcgctgttacaaaggcatgaagcgttacggacatcatttgttttacgaaacggggagccgatgcagcacgtacattcacatgtcgatctcgatctcacagagattcacatgccatccgggacacttcttcaagaggcgatggaaactttcgtcaaaccgtttgacgtggaaaaagcgccgcttttgagagtgactttagccaaagccactgaagaacgtcattttctgctgcttgatatgcatcatcttattgcagacggtgtgtcaatgagcgttctgatccaagaattgacggatttgtacagaggaaaagagctgcggccgttaaaacttcagtacaaagatttttccgtctggcagcatgagcggttcgccgctgaagaattcaaaagacatgagcggtattggctggatgcgatcggggaaaatattccccttcttgatctgccgctcgataaaaagcgcccgcagcttcctgatttcagcgggtccgttgttcgaacgcgcctacaaaaagaaacggcggagaatttgcgccggctcatggatgagacgggttcgacactgtatatgattcttttggcaggctactccttgttcctttctaaattgagcgggcaggaggacattgtcgtcggttcacctgcggccggcagaagccgcgctgagcttgatggggtcatcggcatgtttgtaaataccgtggcaatgagaagcaggccgaaaggggataaaacattccgcgcttatttagaagaggtgaaaatgctcgccctcggcgcagccgaacatcaggacttcccgtttgaagaacttgcccaaaagcttgatacacaccgggaagtcaatcgcaatccgctgtttgatgccatgctcgttttgcaaaacagtgatgatttcaaagtgaaccttccgggcttatccgtttcttcacatgcagtgaaacatgacatttcaaaattcgacttgacgcttcatgccgaggaacggccggacggctcactggattttcattttgaatacagtaccgcgttgtttgaaaaaggtacgatcgaacggtgggccggtcattttaaagagcttttaggacaaatcgcatcggatgatgagcggaagctgtctgacattcatttgctggacacaaatgagcggcagatgcttcttcaagcggaaaatcaaacagctgagtatccgaggcatgagacgatcgtcagtttatttgaggcacaggcggaaaaaatgccggatcaaattgcagccgttatgtccgatgagcgtctcacctaccgcgagctcaatgaaaaggcggatcgaatcgccgatatgctgtcggaaaacggcatccgctccggacagattgtcggaattatgaccgaacgatctcctgaaatgctgatcgggattttcggtattttaaaagcgggaggagcttatctgccgattgatcctgactatcctgacgagcggatttcatttatgctgactgacagcggcgcgcgtgttctgttgacgcaatcgggtcttgggatatccggaatggacgggctgccggttttatacatcgataagcctgaatccgtttcagcagacagaacgaaagaaatgataacgcctgaacagccggcttacgtgatttacacatcgggcacaaccggaaaaccgaaaggcgttatgacggagcaccgcaatgtcatcagccttatcacacataaaggactgccgtttgatttcggcactggagacgtctggaccctgttccactcctattgctttgatttttctgtctgggaaatattcggcgcgctcttatacggcggaaaggtagttatcgtgccgaaagaaactgcccgtgatccgcatttgtaccggcagctgctgcaaagtgaaggcgtaacggtgctgaaccaaacgccgacggctttttccggactcattcatgaagaagccgggcatgcggacaagctgaagcttcgatatgtcattttcggcggagaagcgctccagcccggcatgctgaaaagctggaaagagaagtacccggagacagagcttgttaatatgtacggcattacggaaaccacggttcacgtcacatgcaaaaaactgaatatggatgatattgagagaaataaaagcaatatcggcagaccgctggaaaccctccatgcttttgtcatggacgcctatatgaatccgcagccgatcggaattccaggtgagctttatatcggcggggaaggcgtcgcgaggggatatgtaaacagggatgatttaaccgcctcccggttcatcacgaatccgcacattaccggcatgcggctctaccggacgggcgatattgccaaaagactctcaaatggcgagctggaatatgtcgggcggaaagatgcgcaagtaaaagtcagaggccacagaattgagctgggagaaataaaatcagcgctgcaggagctttccttcgtgaaagaggccgccgtgatcacacgtgctgatcagcacggtcagcactccatttacgcatacgcggtcttacacgggaatgaaaaaataaaagaagcagaggttcaggcctctctcagagcttttctgccggaatatatgattcccgcccgcttgatagagcttgatgaactgcctttgacggcgaatgggaagctggacgagaaggcgctcccgcagcctgaattaaatgaaagccttggagatgatatcagcctgagaaatgaaactgaagaaatgatggctgacatctgggaagaactcttaggtgttgaaggactcggccccaatgctcatttcttccatctcggcggggattcgattaaagcgctgcaagtatgtgcgaggctgaaacagcagggctatgaaacgaccgtccgcgagctgttcgagcatcagacactgggagaagtctcgatgcggctccggaaagtccgccgcgtgattgatcaggctcccgtcacgggagacgtgccgctgacgccgatccagcactggttcttttcgcaatcattgccgcatgatcattttaatcagtccgttatgctcagcagtgcggacaggatcaatgaatctgctatgagaaaagcgctggcacagctcgcggttcatcatgacgcattacggatggtatgcggcacgcaaaacggatcagtgattcaatataacagagcggataacctttctgaagaagaactctttacatttgaaacgcatgacgtgagagggaaagggttattacaagaggaacacgccgcaattgaacaggcggccgcccgcattcaaacttccattcggctggagacgggtccgctcgtagctgtcggtttatttcacgctaatgatggcgatcatctgctgctttccattcatcaccttgtcattgacggagtgtcatggcggattttatttgaagatctcaccgcgtgctacaggcaggcgctcgaaggaaaagaagccgcgcttccggcaaaaaccgattcctatcagacttacgcgaagcaaatctctgattatgcaaaaagccgccggctgttacaggaagcagactactggtccgaaagagaaaaagcggcggtcaaaccgcttccgaaagatgcccgcatctcttccaatcttctgaaagatacagatgtgatgaccgttacattgacaaaacaggagaccgagcagctgttaacggaagcgaacagagcatacacaacagagacgggcgaattattgcttgccgcgttaagcctagcgctgaacagatggaccggaaacgagacattcaaaatcagcatggaaggccacggaagggaagagcacctggagcatcttgatatcagcagaaccatcggctggtttacgtcaatttatccggtattggttgacgcaagttttcaagatcagcctgatgacggcgagcgtctcggctatcacattaagcggacaaaagacatgatgcgccgcataccgcataaaggagcgggatacggggtgctgaaatatataagcaaactctggggagagactgaatctgattctcctgaaatcagttttaactatctgggacagtttgaccgggaaatccgttccagcggcttcggtgtttctcccgtaaaagcgggaaatgaagtcagcccagactgggaacgtccgtacacacttgatatcagcggctccgtatcgtcggaatgtctcagcatgcatgtcgtgtacaaccgttttcagtatcaaaaagaaacgattgaagttttgacgggatattttcatacctttctcaagcagattatcacgcattgcacaggcaaagaggagcgtgaatggagcgccgctgatttcagtgacgaggagttaacgctggaagatctgagtgacattatgggagccgtcaacaaactatagaaaaggagtggcgcaatggggcagcaaccggaaatacaagatatatatcctttgtcttttatgcaggagggcatgctttttcattctctgttggatcatgactcaagagcctacttcgaacaagcggtgtttacgatcagcggacagcttgaccgggaacggttccaaaaaagtatagacactgtttttgaacgatacgatattttccgtacgacatttattcacaagaatgtggcaaagccccgccaagtcgtgttgaaaaacaggccgagccgcgttcagtttcatgatatttctcatttggacgagaaggcacaagacaaatatgccgaccggtttagaaaagaagataaagataaaggctttgatttgcaatcagaccctctcatgagagtctccattttgaaaaaagcgcctgaacgctatgtttgtatatggagccatcatcatattgtcatggatggctggtgcttcggaattgtcatgaaggaatttctgatgatctatcaatctctcggagacgaacggcttccgttcctcgagcccgttcagccatatgggaagtatattaaatggctcatgaagcaggatcgtaaagaagccgagattttttggaaaacgagacttgccgatcttgagcaaacggcgtctcttccgaaaaaatccgcggaaccaaacggcgaacttgagcaggcggttttcaccatttctgaagagcagacaaatgagctgaagaacattgcggcaagggcgggagcaacgctgaatacagtgttccaggcactgtggggcattttgctgcagcgtgtcagccgctgtgatgatgccgttttcggttctgtcgtttccggccggccgtcggatctcgcaggcgtggaaaaaatggtgggactgtttatcaatacgattcccgtacgggtgaaaagcggttcattttcttttctggagcttgtcaggcatttgcagcaggagacgctgcaagcagaagcgtacagctattatccgctgtatgacattcaggcgcaaagccctctgaagcaagcgctgtttgaccacattatcgtgtttgaaaatgtgccggcccagcgtgaaattgaaaatgtgagtcaggccggttcatttgattttgcggtagaggattttacgatggaagaagtcacaaactacggatgcagcataaaggtgattccgggcaattctctttatatccgcttaaaatttgataccggtatatacgacgatgtttttatgaagaatatcgaaacatttttacggcatatggtgaactcagtcatttccgaccctgaaatcggcgcttccgagatcgcattgctggatgcgtgtgaagccagaagtatgatggatgcatttaaccatacagaagcggttgaaccgccggctccgacgcttcacgggctgtttgcccgccgcgccgcgctttcgccgcatcgtccggcgctccgttttccgggcggtatgctgacgtacgctgagcttgaccagtacacggacaggctcgccgtccggctccgacaaaaaggcgtccgcaaagaaagcatggtcggcgtactcgctgaacgctcgccggagatggcggtttcagtgcttgccgtgttaaaagcgggcggcgcctacgtgccgcttgacccggagtatcctgaggacaggctgcgatatatgcttgaggacagcggcgcttgtctcctgcttgcacagccggggttatccgtttccggtttttccggtgaaacgctagaagtgtctctttcttctctgacaaatgagacggagacaggggctgtctctgaagaagcggatgctgattcgctcgcttatatcatttatacgtccggttcgacgggaacaccgaagggagtggctgttgaacaccgtcaagccgccgcctttttatcagggatgcaagggcagtttccgttaacggaagaggatattatcgtgctgaaatcatccttttcattcgacgcctccatctggcaattgttttggtggacgatgtccggcgcctccgtgtatctgcttccggccggctgggagaaagatcctgtgcggatgattgaagcgtttgcctcagaaaaggtgacgaccgcgcattttattccggcgatggtcaacagctttttagacgcgctggaaacagagcctgcggaaacaagaacacgcctcggcagaacactgacacgcgtgttcgccggaggggaagctctttccccgcttacggctgcccggtttgccgatcttctgccggagaccatgcttattcacggctatggaccgacggaagcgacggttgatgcggcgttttacgtctgtgaccgaaaacgggacagcggacggacaaggcttccgatcggaaaacccgttccgggtgcccgtctgtatgtattagatagcggaggaaccatccagcctgcgggcgtggcaggagagctgtacatcgcggggaccggcgtggcccggggctatctgaaccgccctgagctgacggaggagcgctttgtcgttgatccgttttatccgggagaacgcatgtatcagacgggcgatatcgcacgctggacagaagacggccttgtcgaatggctcggtcgttcagacggacaggtgaaagtccgcggctaccggattgaaccgggggaaatcgaagcggcgatccggcacatcgacggcattcgtgaggcggcggtcaccgcccggaccgaacacggcgaaaccgcgctttacgcctatattgaaggacgaaaaagcgatgacgtgcgggcggagcttgcgacacgccttccggcctacatgatgccggctcagtttatagagatgagcgaatggccggtcacgccaagcggaaagcttgaccgccgcgcgctgccggctcccggcggatcggcagacagacaggcgtacactgccccgcggaacgtcacggaaatgaagctttgcgccctttgggaagaggtgctgaaaaacggccccgtcggcatccgggatcacttttttgagcggggcggccattcgttaaaagcgacggctctcgtctcccgcatcgccaaagagttcggtgttcaggtgccgttacaggacatcttcgcccggccgacggtggaagagctcgcttcggttattcaggacttggaagaaagctcgtatgaagcgattcagcctgcgcaaacacaagatacctacccggtgtcttcagcgcagaaacggatgtatgtgctccaacagcttgaagacggcggtgtcggctacaatatgccggctgtgctggaactgacgggcccgcttgaccgtgtccggctggaggagacgttccggcagcttgtggagcggcacgagtcgctcagaacgtcctttgaaacggggcctgacggcgaaccggtgcagcgcatccatgacagcgtgccgtttcagctcgatgaggccgagtcagctgacgcattcgtccggccgttttgtctggaggaagcgccgctcttccgtgcggccctcgtgaaagaatcggaagaacaccatcttttattaacggatatgcatcatattatttctgacggtgtgtccgtcaacaccttgataaaagaattcggcgagctgtacgcaggccgttcgcttgcgccgatgcgccttcaatataaagactatgccgtctggcagcggtcgtttcaggagaaagaaggatatcagaagcaggaagcctattggctgaagcggcttgaaggagagcttccggtgcttgaacttccggctgacaagccccgtccggcggtcagaagctttgcgggcggcagcgtatcgtgcacgcttgacgctgacacggcatccggccttcaccgcatcgcccgggatcacggctccactttgtatatggtgcttctcgccgcgtacaatacgctgctcgcgcgattgagcgggcaggaagacatcatcgtcggatcgccgattgccgggcgcccgcacaaagaccttgaaccgattctcggggtgttcgtcaacacgctggccatcagaacggagccgaaaggagacaaacggcttaccgattatttggcggaagtccgccaggcggcgcttgaggcgtatgaacatcaggactacccgtttgaagagcttgtggagcggctcggcgtgcagcgggacatgagccgtaatccgctgtttgacgtgatgtttgtgctccaaaatatggagcgtgaatccctgaatttaaatgagctgcatttgactcaagccgcggatgcaggtcataaaaccgcaaagtttgatgccacgctttacgcggcagaagggtctgacggttccatcagctttgattttgaattcaatacagatatctatcaaaaacagacaatcgaaaaatggctttcttattttacccgtattcttacaaaagtaattgaagaccaaacaataccgcttggtgacattcacgtactggatgatgctgaaacaaatcgcgttatttatcagtttaatcagacgaaaagcgattacccaagacacgaaaccatcagccgtttatttgagcggcaggctgaagaaacccccgatgcccgggcagttgtatatgatggacaaatcttgacataccgtgagctgaacgaacgggctaatagaatagcggcggctctccgatcaaatggcgtcggtccggaaagtgttgtcgccttattaaccggacgtacaacagagcttgcttccggaatcctcggaatattaaaagcgggaggcgcctacttgcctatcggtgacgatgtgcctcgggaacgggctgaatggatgcttaaagactgtaaagctgatattcttctccaatctgataaacttgacggtctgccgctttccggaaaacgtttattcatagaggatattcaaacaaaggccggcttaagttcggaaaatcccgaaccgctcggcggacctgaatcattggcctacatgatttatacatccgggtcaacaggtgcgccaaaaggcgtcatgattgaacagcgaagtgtgatccgtcttgtgaaaaacagcaattatattgattttacgccgaaagacagactgttgtttacttcatcattaggatttgatgtaacgacatttgaaatattcggtccgcttttaaacggtgcttctttatatgtaagtgaccaggaaacctatctcgactctgatgttctggaaacatttatacagcaaaacggcattacgacactgtggctgacatcgtctttgttcaatcatctatcagaacaaaatgaacacgtgttttccggattatcccgattgattatcggcggggaagcactgtccccaagtcatgtaaaccgggttcggaaaacgctgccgcatctttcaatatggaatggatacggaccgactgaaaacacgacgttctcgacttgctttttgattgaacaatcatacgatcattcaatcccgatcggccgccctgtcggaaattcaactgcatatatcataaacagcaggggaacaccgcagccgatcggcgtcatcggtgaattatgcacaggcggagacggtgtggcaagaggatatttcggccgccctgagctgacggaagaaaaatttgtccctaatccttttgttcccggagaacggatgtaccgcaccggggatttagcccgctggctgccggacggaacgattgaatatgccggacggatggatgatcaagtgaaaatccgcggttatcgggtcgagctgggagagattgaagccgcactaaggagcctggacggcgtgaaagaagctgccgtgtcagtcagaaccgggcagtccggcaataaagaactgatcgcatatatgagtctgcaggcggacatggatacagaaaaagtgcgttcttcactttctaagcaactgccgaattacatggtcccggcctatatgatggaacttgagaagctgccgcttacgccgaacggtaaattggatcggaaaaatctgcccgaaccggagctcgcgcttcaaaccgcgtacacagctccccgcaatgagcttgaagaacagctttccgtgatctggcaggaagtgctcggcacaaaacaagtcgggattgaggattcattttttgagttgggcggcgattcaatcaaagcgctccaagttgccgcacggctcggacgctatgggtggaaaatgacggcaagtgacttattccggcatccgtccattaaggaactcgcgcctcttatccggaaagcggaaagagtcatcgatcagcaaccggtggaaggagacataccttggacacccgttcagcactggtttttatcacagcggatggaaaacagaaatcatttcaatcagtccgtcatgatgttcagctctgacgcattgcataaacagccgctcaaacaagccttggagcatcttgtcattcatcatgatgcactccggatcaccgtcagtgcagaaaacgaaagtatcagacaaatcaatcacggtattcaaaaagatgaactgtacagcttggacatttgggatctgtctgagacagatacttgggaaagagaaatagaagatgaagtggctgcgctccaacagcggatggatattgaaaaaggaccgttattaaaagccggctggttcaaaacccggtcaggggattatttattcatcaccgtacatcacctggcggttgacggagtgtcatggcgtattctgctggaggatttatctgccgcttacacacaagccgtaaaaggtcagccggtccagcttccgccaaagaccgattcgtttaagcaatacgccgtaaggctttcagaatacgcaaaaagcagcaagctgatgcgtgaagaagaatattggcgttttattgaagaagaaacagccgccggacttccttatgaaaaaccgcagtatcagacgggagccgacagcattcggcaaacggtaagctttacgcttacagaagaagaaacgtccgttttgcttcagcaggtcaaccgggcctaccataccgatacgcaagatgttcttctgactgccgcagctttggctttacgggactggacagggggcggcagactgcgcatcgcgatggaagggcacgggagagagcacatcatgccggagctcgacatcagccgcaccgtaggctggtttacctccatgtacccggtgctcattgacttgaacacagcaggcgctgagcttggaacggctgtaaaaacggtcaaagacacactcggaagaataccggataaaggaataggctacggcattttaaaatacatgacaccgcctgaacaaaaaacaatccgcttcagacaagcgcctgaaatcagttttaactatttagggcaattcaatgatacagaagatcagcccacattcagtttatccggtcttgcgagcgggcacgacatcacgccgacatggcagcgggaacaagcggtggaaatgagcgcgatggccgctcaacataaactgcacttcagtttgagctatccgccgagccgcttccgcaaagaaacgatggaacagctgctgcaaaccttacagcaatatttgcgtgatattatggcgcactgcacaggcaaagaggaagcagaaaaaaccgttagtgattttagcagcaaaacgttaacatctgatgatttggacagcatagcgagttttgtcgaggaactgtagaaaaaggcgacggggagattataacatgacaaaaaagaatgcaattcaggatatttatccgctgtcttatatgcaggaaggaatgctttttcattccctcctgcaaaaggaatcacaggcttacgccgagcaggcctccttttcaataacggggaaggttgacacccgcgtgtttgaagagagcgttcatgcccttttcgaaagacatgatattttcagaacgatctttatcagccagaacgtgtcagtgccgcagcaggtcgtattaaaagagcggaacgtcagcatcattgaggaaaatctcaccaatttaaacaaggctgatcaaatcaagcatattgaagaagccaaacgaagagaccgaaagaaaggatttcacctgcaaaaagacatgctgatgcgggtgacgctgcttcaaaccggtgaatgtgaatatacgtgcatatggagttttcatcacattattatggatggctggtgtctcggaatcgtgctgaaagagttcttccagatatacgcctcgcggctccgccggacaccgttaacgcttgagcccgctgtgccgtacgggacctacatcaagtggctgatggagcaagataaagaaaaagccgcttcgtactgggagcgataccttgaaggctttgagcagcagactgttctgccgaagcagaaaaaagccggcgaaagcagccaagaggaagtgacgttttccttttcaaaagaggacacagctaagctgaaagatctggccgtgaaagaagaggtcacgctgagcaccatttttcacacgctctggggcattttgcttcaggcgtataaccagacagaagatgcggtttttggttctgttatttccggaaggccgtctgaaatcaaaggcatcgagcgaatgatcggcctgttcattaataccgtgcctgtccggatcagcggggcggacattccgtttcaaaagctgatcaaaaacgtgcaaaaggacgctttgaaaggacaggcatacagctatcatccgctttatgatatacaggcgaattcacaggtaaaacaaggcttaattgaccatattctcgtctttgagaattatccggttgaacaggagcttgatgtactgaacagcaagggggacacgaaagacctttttcacatccatgatttcagcatggaagacgaaaccaattacagtttttacctgatggtggcgccgggtgacgagattcacttgaaaatgagatacgattcaagcatgtatgaccgccaatttatcgaaaatatcaaaggtcatttgacacatatcgtttcccagattctcgacaaacctgatatcacgccggataagcttgtaatcatcactcctgaggaaaaagagcagctgcttgcgccgatttctgaagagactgaaaagcctgagtatgacacgattcatgcgatgtttgaacggcaggccgcacaaacgccggatcaaatcgcgatccggtatgaaggcgggtcagtgacgtacaaagagctgaatgaatcggctaataagctggcccgtctgctgcaaaaacgcggattaaagcgggaggagccggtaggcgtcatgctcggccgttctccttctttagcggcggccgttctcggtattttaaaagcgggcggcgcctttgttccgatagatccgggcagtccaaaggagcgtatccgatatgttattgaaaacagcggctgcatccatgttgtaacagagcggcatcagtcactccccgcggaacaaacgctgcaggttacatatatagaagaggccgggacggaagcggacggaagcaatgtgcaatccattaatacggcggacgacctcctttatatgatttatacatccggtacgacagggaaaccgaagggcgtgctgctcgaacataaaaatatggccaaccttctttctgaccaattgacgaacacaggcattgatttttgcacaaatgtgctgcagtacgcatctttggcgtttgacgtctgctatcaggagttattttcagtactcttgagcggcggcaccctttgtatcgtgcccgaatcaatcaaacgggatgtttctcagctgtattcgtttatcgatcagcacaaaacggaagtggtgtttttcccgactgcgtttgtcaagatgcttttcaatgaagaaggttatgcacagtcttttccccgctgtgtgaagcatgtcattacggccggggagcagctgactatctcacgtttgttcaggcagacgctccgtttacacggtatgcagctgcataatcattacggcccgtcagaaacccatgtggtttcaacgtatacgatttctgcgggagatgacatacctgaacatccgccgatcgggaaaccgatccatcataataagatgtatattctcagcaaaaacagacagcttcagcctctcggaattgcgggagaattgtatatttccggagcgaatacaggaagaggctatgtgaacaatccggcgctgaccgaagagaaatttttgccggatccgttcagaaagggcgccgtcatgtaccggaccggagatttggcaagactgcgtgcggacggccaaatggaatacatcggccggacagatgatcaagtgaagatcagagggtaccggattgaaccgaaagaaattgaaaccgttctggcaaatcatcatgccgtgaaagaagctgccgtgctgattcaaacgaatgagtcgggcgaaaatgaattatgcgcctactgcagcgtctcacaagcgactgatccttctcagctgcgaagtgatttggccaaagagctgcctgattatatgattccggtcaaatgggctttcattgacgcgattccgctcactgcgaacggtaaagtcgatcagcgggcccttccggaagcttcggcgtacgcagcgggccgtcgatatacagctccccggaatgtgaccgagctgaagcttacccgcatatgggaagaagtgcttcaaaccggcccgatcggcgttcacgatcactttttcgagcttggcggccattcattaaaggcgacggcactcgttgcaaaaatagctaaagagtgcagcgtgcaaatcccgctgagtgatgtcttcagctatccgactgtagaagaactcgccaaaatcatcggtgaagcagaagagaatccgttcgcatccatagaaaagacagaagcaaaaggaacttatcctgtctcatccgctcaaaaacggatgtatgtccttcaccagcttgaaaatggcggtgtcagctataacattccagccgttttagaggtgaaggggccgtttgaccgagacaggatggaagccgtgttcaaggagctgatccggcggcatgaaccgctcagaacgtcctttgaagaaaaaaacggccggcctgtgcagaggattcatgacgaagtgccgtttgcatttacaaaagaacaatcagccgaagcgtttatccggccgttcgatctcggcaaagcgcctcttttccgggcgggatttgtccaaatagaaaaagaccggcatctgcttttagctgacatgcatcatattatttcagacggcgtatccgtcaatcttttgatacgtgaattcagtgagctgtatgctgagagaagtctgccgccgttacggattcaatacaaagattatgccgtctggcagcaatcatttaaggcgggcgccgcatatcggaaacaagaggagtactggctgaaccggcttgccggggagattcccgtgcttgaattgccggctgataagccgcgtcccccggtgcggagcttttccggtgaccgggtgtcatttgtcatcagcgaaaaacatacagcgcagttgaaaaagctggcgaaagaaaacaaatgcacactttatatgacgctgctcggtgtgtacacggttctgttagcccgtttaagcggacaggaagatatgattgtcgggtctccgattgcaggaaggcctcatgccgaccttgacgccgttctgggcatgtttgtcaatacgctcgctttcaggacgcgtcccgacggaagcatgacgttcaaagaatatttaaaggaaattcgccaaacagcgcttgaggcttacgagcatcaggattacccgttagaagagctcgtcgataagctcggtgtgccgcgggacatgtcccgaaatccgctgtttgacacaacatttgcgctgcaaaatatggaacagcagaagcttagggcagccggacttgaactgcagccggcagacgtcagcctgccgatttctaaatttgacttatcgctgtacatctccgaaaacgccggtgaattgtactgccagtttgaatacagcactgatttgtttgagagaaaaacgattcaaaaatgggcggaatttttcacgacacttgctgaaaacgccgcagctgatccgggtttggaattagacgatatttctgttttgtcagaaaaagaagaagtgtctctgcttcaaaatttcagccccttgcagaaaacagcgtttccgcttcatcagccccttcatgagctgctggaacaacaggcggaaaaaacgccggaccgtccggcgattttaactgatgagatttcgattacgtatcaggaactgaacgaaagagcgaatgagcttgcgcaccggctgatcaaacgggggataaggctggaggataaaactgccattatgggccggcgttctcctgacatgctgatcggcatttacgctgtcttaaaagcaggcggtgcatatctgccgattgatccggattacccggaagagcggattcgctttttactgaaagacagcggcgtgaaattcttactggcagaaccagaacttttcgcaccagatctttttaagggagaaacgatctctctgaaaagcggacaaacaggaaacccggaagctgcggccaaccccaatgttccggtaaagcctgattcattggcttatatcatctatacatccggttctacgggacgcccaaaaggcgtgcaggttgaacatcagtcagccgtaaactttttatactcgctgcaagcgcgttatggattaaaggattccgacaccattttgcataaaacatcatactctttcgatgcttcgatttgggagctgttttggtggccgatcgcgggagcttctgtttttctccttccgcaaggcggcgagaaagaccctgaaatgatactgaacgcattggagaaaaaccgcatcacggcagctcattttgtgccatccatgcttcatgctttcttggaatatataaattccagaaaacagccgatcaaaaagacctgcttaaaaagggtttttgccgggggcgaacaattgggcccgcacttggtttcccgtttttatgaccttctgccgggaacggaattgacaaattcctacggtccgacggaagcgacggtagaagcggcgtacttcgatttgccgcaaggaaaggaatttcacaatgttccgatcggcagttccggacataacatgcggctgtatattttaaatcaaaagaaacagcttctgccgccgggctgtatcggagagctgtatatcgcagggaccggcgtggcccggggctatctgaaccgccctgagctgacggaggagcgctttgtcgttgatccgttttatccgggagaacgcatgtatcagacgggcgatatcgcacgctggacagaagacggccttgtcgaatggctcgggcgttcagacggacaggtgaaagtccgcggctaccggattgaaccgggggaaatcgaagcggcgatccggcgcatcgacggcattcgtgaggcggcggtcaccgcccggaccgaacacggcgaaaccgcgctttacgcctatatcgaaggacgaaaaagcgatgacgtgcgggcagagcttgcggcacgccttccggcctacatgatgccggctcagtttatagagatgagcgaatggccggtcacgccgagcggaaagcttgaccgccgcgcgctgccggctcccggcggagcggcagacagacaggcgtacaccgccccgcggaacgtcacggaaatgaagctttgcgccctttgggaagaggtgctgaaaaacggccccgtcggcatccgggatcacttttttgagcggggcggccattcgttaaaagcgacggctctcgtctcccgcatcgccaaagagttcggtgttcaggtgccgttacaggacatcttcgcccggccgacggtggaagagctcgcttcggttattcaggacttggaagagagcccgtatgaagcgattcagcctgcgaaaaaacaggacacctacccggtgtcttcagcgcagaaacggatgtatgtgctccaacagcttgaagacggcggtgtcggctacaatatgccggctgtgctggaactgacgggcacgcttgaccgtgtccggctggaggagacgttccgggagcttgtggagcggcacgagtcgctcagaacgtcctttgaaacggggcctgacggcgaaccggtgcagcgcatccatgacagcgtaccgtttcagctcgatgaggccgagtcagctgacgcattcgtccggccgttttgtctggaagaagcgccgctcttccgtgcggctctcgtgaaagaatcggatgaacgccatcttttattaacggatatgcatcatataatttctgacggtgtgtccgtcaacaccttgattaaagaattcggcgagctgtacgcaggccgttcgcttgcgccgatgcgccttcaatataaagactatgccgtctggcagcggtcgtttcaggagaaagaagggtaccagaagcaggaagcctattggctgaagcgacttgaaggagagcttccggtgcttgagcttccggctgacaagccccgtccggcggtcagaagctttgcgggcgggaaagtatcgtgcacgcttgacgctgaaacggcatccggccttcaccgcatcgcccgggatcacggctccactttgtatatggtgcttctcgccgcgtacaatacgttactcgcgagattgagcgggcaggaagacatcatcgtcggatcgccgattgccgggcgcccgcacaaagaccttgaaccgattctcggcatgttcgtcaacacgcttgccatcagaacggagccgaaaggagacaaacggtttaccgattatttggcggaagtccgccaggcggcgcttgaggcgtatgagcatcaggactacccgtttgaagagcttgtggaacggctcggcgtgcagcgggacatgagccgtaatccgctatttgatgccatgcttgtcgttcagaatatggaacatgaggaattgctgttggacggtttgcatattcagcctgcggacgtgtcccgtccggtttccaaatttgatgtcactttgcaggcttctgaaggcgggggacagattcattttctgtttgaatatgcggcgtctttattccggaaagaaacgatgcagcgctgggcttcccactttatgacgatgcttgaacacattgtccgtgaaccggaaacttctatacaagcgatcagcatgctgactgctgcggaacgggaccgaattctttcggactttaacggcatgacggataaacagctgcctgaaaaaacagttcatgaactgttcatcactcaggcgcgaaaaacaccggatgcggcagcccttatcagcggggaaacgttggtcacatataaagaattagatgaatggtcgaataaaatcgccagagctctgcaaaaacggcagatcggaccgaatgccgccgtcggcattgtgataccaagatcaccggaacaagtcgccgcagtcttcggggtttggaaagccgggggcgcctacgttccgatagatcctgaatacccggaggaacgcaagcaatatatcatttcagacagcggcacagcgcttctccttaccgtacacggcgcaatagatcaagtgcctgatcattttaaaggtgaagtgctcgcactggaggatatccaagaacaagacgcatcaccggttcagccattatcagcaccggaagatttggcttacatcatttacacgtccgggacgacaggcaggccgaaaggggttatggtcgaacatcgttccgtcagccaaacccttcaatggcgaagcggattttatgatctgaatgagaaagatacggttcttcagcttttttcattttcatttgacggttttgtaacaagtatgttcacaccgctgatttccggtgcgaaagcggccgttttagccgaagatgaagcaagagatattcttgccattaaacactatcttgcatcttaccgcatcactcatatgatcattgttcccgtactgtaccgtacactgcttgacgtactggagccgggggatgcagagtctctcagaattgtcacattagctggagaagctgtcgaccaaaacattatcagccgcagtttatcagtttgtcctcacacggagcttgccaatgagtacggcccgacggaaaacagcgtcgccactacagcggcaagacatatagaacaaagtgagaacattacgatcggccggacgattgagcattcacacgtttatattttaaacggggatcacccgcagccgatcggtgtaacgggagaactttgcatttcgggttccggccttgcaagagggtaccgcaatcttcctaagcaaacggcccaagcctttgtccaagacccgttccagaagaaccggcgcatgtaccgcacaggcgatctggcaaaatggctgccggacggcacgctgcaatatatcggccgaatggacgagcaagtcaaaatcagaggctaccgggtggaactgaaagaaattgaatcggccttaacaggcataaaaggtgtcaaagaagcagccgtcaccgctcataccgcatcagcaggccaaacggaactatgcgcttatatcgtgacagaagaaggaacagaaagtgaaaccgtgcagcaggcgctcagaaatgaaatgcccgcttatatggtgccggcgttctttgaaacacttgaagccctgcctgtcacaccgaacgggaagcttgaccgccgcgcgcttcctgagccgcggaaaaaagcgcacaccggacgggcatttacggagcctgaaagcgacatggaaaaagagctttccgcgatttggagcgaagtgctcggaactgaaaacattgccgcggatcaatcattttttgaactgggcggcgattccatcaaagccctgcaagtatcagcccgattacatcaggcaggaaaacagatcgccgtaaaagatattttcagccggccgacaattagagagctggcgccttatgtccgtacagagcggcagccggtcagccaagctcctgcagaaggagaagtgaagtggtcgccggttcacaaatggttcttcacacaagacatgaaggaagcaaatcattttaaccagtccgtcatgctgacgagaacaaattcaatagatgaagaggctctcaggaaaacgttaaaagccattaccgttcatcatgatgctttgcgccttgtctgcaaaaaagacgaagagaaaggtcttctcctcttcaacagaccggctgacctcgcagatgagcagctttacaacctgaccatattagaaacggaaggcgatgagcatgagaaggaacgttttataaaacgccgcgtcgcagagcttcagagaaacatggatttggagaacgggccgctggtacaggcgggactgttccgctctgaagcagaagattacttgtttctgacggtccatcatctcgctgtcgacgggatatcatggcggattttattggaggacttggcttctgcttatgagcaggccgcctctggacaggaaatcaaactccctccgaaaaccatgtcattcaaaacatatacggagcagctggccgattatgccgaaagcaaacagcttcttcagcaggcggagtattggcgggagattgaacactatgaaacagaaagtcttccttacgagcaggcagatctatctcaaactcctgcaaaaaaacggaacacggtatccttcactctgacagaaagtgaaacggacgccctgttgaaagatgtgcacagcgcctacaatacggatacgcaagatgtgctgttggcttccgccgtgcttgcccttcaaaagtggtcgccgcagcacgctttgaaaatcgcccttgaaggacacggacgccaatcggagcaggcaggtgcggacatcagcaggacagtggggtggttcacttccatttacccggtgcttgtccggagcggagtttatgaacctcttgaagaatatgaaattcgcacattgaaaaccgttaaagacacattgcggcgcattccggataaagggaacggatacggcgtcctcaaatatttaacaccgccgaagcttgccgggatgactttcgggaaagcaccggagatcagctttaattatctcggacaattcgatgcgcccggcgggagtccggcagaaacggaacagcctgacgcgtttcagttttctcctttgggaggcggagatgatgtcacagatacatggaaacgggagcagtcacttgaaatcagcgctattgcggcaaaaggccggatgaccgtcagcatttcctatgaaacggagcgcttccggcaagatacgatcgaacggctgtccgaaagctgccggtattatctcctgaaactgtcggaacactgcctcagcaaaaccgatacggagaagaccgtcagtgactttgatgatcgggagctgactgaggaagccttgcaggatattgccgacttactcagcttccactaaaccgagcgggaggaacacatggacaaaacaaaaaacatccaaaatatttatcccctcagccgaatgcaggaaggaatgctttttcattcctttctgcaaaaggagggggctgcatatatcgagcaatccgtcttcaccataaaaggccggcttcgtccggaattgtttgagcaaagcgtacagtctgtcatcagccgtcacgatattttcagaacggtttttttacctcatgtcgctcagctgaacggcccccgccaagtcgtgctgcgtgagcgggaattccggctgcaccgcgaagatcttacacatttggatgaagcggaacagagcgcctacttacagcgatttaaggaacgtgaccgcttaaaaggctttgacttgcaaaaggatatgctgatgcgtgtgtctttgtttaaaacggctgaggaaaaatatgtatgcgtctggagccaccatcacatccttatggacggctggtgcctcggcatcgtccttcaggaattcatgcatatgtaccgggcgattgaatcaggctcacccgtcacactggcgcccgcaaagccttacagcacgtatattacatggctgactgatcaggacaaagacgcggcttctgagtattggaaaggatatttagcaagctgcgagacaccctcaggactcccgaaaatatcggcccgtccccagggaaaaggctaccgtaagaaagagctcctgttttctttagatcaaaatctgacagacaggctgaaaaccatcgccaaagaagagggcgctacgctcgcggttcttatgcagactgtatggggcctgatgctgcagcgctacaaccggacggacgatgccgtattcggcgccgtcgtatcagggcggccttccgtcattgacggcgtggaaagcatgatcgggctgtttatcaatactgtgccggtacgcattaaaacgggtgacgaaagctttagagaactgctgggccgctgccagaaagaaatgcttgattcagaggcgttcagttatcatccgcttgctgacatccaatctcagactgagctgaaacaggatttaatcgaccatatcatcgtgtttgaaaattatccgattcagcagcagatgagagacgcggaaaaggaatcggatgcaccgttccggatcgggaatgtcaatgtttcggaacaatcgggctacgattttaacctcatcatagcgcccggcgatgagctgatcatcaaattcagctacaatgcgaacgtttatgacgaagtatggatagagagcgtaaaaggacacttggaagaagcgctgcgcggcgccgccttcaatcccgatgttcccgctgatcggcttccgatgctcggacaaaaggaaaaatcaagaataatcggcgaatttaatgacacgaaaacaacgtatgaaagagacgaaagcatcatcagcctgttcagccgacaggtgaagaaaaccccggaccatcaggcgcttcacgccggcgggctgacgatgacgtaccgggagctcgatgaacggtcaactgcgttcgcccgcatcctgctggaaaacggtttggcgccaaaaggaattgccgggattcttgccgaacgctcaccggaatttatcatcgctgttctcgctgtattgaaagcgggagggacgtaccttccgctcgatgcagaactgccatccgacaggatcgccgaaatgctcactgagagcggagcacagctgttaacggtacaaaaagggattgagactgacattgacttttctcacatcatctctatcccggctgcagctgaaaaacaaacagctgatgagggaaaactgaataccgttacgtcacctgatgaccttgcctatattatgtatacatccggttcaacaggaaaaccgaagggtgtgatgatttccaaccgcaacgtcgtatcgctcgtgtcaaacagcaattacacgtcagccggcacgacggaccgtctcattctgacaggatccatcggttttgacgcagtgacgtttgaaatcttcggagcgctattgaacggagcgtgcctccatgtggttgaccgcacgacaatgcttgcccctgagaggttcggcaattatctttcttccaacggtattacgattctgtttttgacgacggcgctttttaaccagtttgcccaggcggatccggagatgttttgcggattgcacaccttatatgtcggcggagaagcattgtccccggcgctcatcaataaggtcagacaccgctgtccgaatctcagcctttataacatatacggaccgacggaaaatacgacattttctaccttttacgaaatcaggcacgatttttctcagccgatcccaatcggaaaaccgatcagcaattcaaccgcgtatatcattgataaaaatggcggacttgcgccgatcggcgtgcctggtgagctttgtgtcggcggggacggggttgccaaaggctatttaaacaggcctgacttaacaagtgaagcatttgtcagccacccggttcatcctgaagaaaagatctacagaacaggggatttggcacactggctgcctgatggaagcatcggatacatcagccgtatcgaccgtcaattcaagattcgcgggaagcgtatcgagccggccgaaatcgaagcgcggctgactgaaattgatggaatcagggaagcggcagtcatcgtgtcagacgaaggacaagaagcaaccctttgtgcgtattatacaggcgcacatgctgaagaaagagccattcgatccctattggccaggtcgcttcccgactatatgattccgcagtatgtgatgaagcttgaccgtatgccgcttaccgcaaacggcaaagtggaccgccgcgggctgcctgcgccggaacggaaaaaagcttcatcaaaagccgttccgccacgaaactgggtagagcgtgagctgatcgacatttggacgccgatcctcggctgcggggagctgggcatacaggatgacttctttgagctgggcggccattctttgaaagcattgcaagtgattcatcagctgaagaccaggcagcagatggacgtcccgattgaaatgatatttgaatatccgacaattgaacaattggctgaaaagctgtattcaaacacactgtcagaagctgccgaacagcatatcagcagactgaatcagccgaaaggccgcaatcttttctgttttccgcctatctcaggtttcggcattttctttaaagatctggcggcggcattaaatggacgggctgctgtgtacggttttaactttattgaagaagacagcagaatggaacaatacattgataaaatgctggaaatccagccggaaggcccttatatcctcttcggatattcagcgggcggcaatacggcattcgaggctgcaaaagcgatggaaaagcgcggcttagaaatcagcgacgtcattatcgcagacgcgtacagaaagcttgacgcactgccgccgcagccaacaaacgcaacagccgaaaatgtcccggaagccgtcagggaagcggtcatcagaaaaacagagcgctatcaaacgtactgggcggaactgataaatgacggccaaattgcggcaaatctccattttattgaggccggcataaaggaagagcacagtgataagaccgagccgatgaaatgggaaggcgccacaacgggagtctaccaggaatatcagggcgagggagcccataaagatatgtttgagcccgagtttgcacacaaaaatgccgaggtcatactggacatcatcgcaaacagcggaagacgcttggcgcggaatctgtaacatccggcagaatgactgaagaagacaaagggcaagataggggaatcacactcagtttttttggaggctttgagatgacgaacctatcttggcttacgtatgtaatgattattcttgccagctaccggctgacccatttgatcgtatttgataagattacggaattcataagaaaaccctttataaagcaagaaaaaaccgtcgatcaaaacgggcgcgccgtccaaaaaaaagtcccttcctccgcattcggttatatgctgcaatgttattggtgtgcgggcgtctggtgcgccatattgatcggcatctgctatttggtctggccccgctatgcacatccggttattttcattttgtccattgccggagcgcaggccattcttgaaacatgcgtcggcgtcggaacgaaggtcattgacgtgctcgccgccataaaacataaaaagtcctgaagcgttttgattcgctttaggacttttttctttcccttttaggctgagaggagcaaagcaggctttctgattcaccgcccggaatgcttcggaataccgtaaagcagagagggggaaaaacatgaaaagctgccgttttagcatgatatggtttttggccgttgtactgacagccggcatctttacgttctcagcatccgcacaagcaagcggcactcagccggagagagaaatgcgagccgtatggatcgcgtctgtcaccaatatcgactggccctctaaaaaagggctgtcaccggaagagcaaaaaagagaatacagcaagctgctggatgacgttcagaagatgggaatgaacgccgttatcgtccaaattaagcctgcggctgatgctttttatccatcagattacgggccttggtcagagtatctgacaggaacccaaggcaaaaatcccggctacgatccgcttgcttttttagttgaagagacacataaacggaatcttgaatttcacgcttggttcaatccttaccggatcacgatgaatcacacaaatttgaatgcgctttcagatgatcatcccgcgcgttcccatccggactgggtcgctgcatacggaaaacagctgtactataatccgggcattccggaagtaagacaatttataacggatggaatcaaagaagtggtcagccgttatgacattgatgcggttcatatggatgattatttttatccttataaaattgccggacaggaattccccgatcaggcggaatacgaacggtacggaaaagctcactttgcatcgattgatgactggcgcagggataacgtcaaccggcttgtaaaagaaatcaacgaaaccatcaaacgagaaaaaccttatgtcaaattcggaatcagcccgttcggcgtatggagaaatgccgcagatgatccgacaggctccgaaacggccgccggggtgcggaactacgatgacttatatgctgatacaagagaatggatccaaaaaggatacattgattacatcgcaccgcaaatttactggagtatcggatttaaagcggcggcatatgacgtcttagcggattggtggggaaaagaagtgaacaatcggccggtgcatttatatatcgggcaggcagcttataaaatcaacaacaatactgatccggcctgggccgacccgggggaatacggaagacagattacgctaaacagaggatcagcatggataaaaggcagcatgcatttcagtttaaaggatttaaaccgtaatccgctcgatgtgaaaaaccgtttgatcaatgacatgtacagccggcccgcattaattcccgagatgccttggctcggacattccgctttaaaaaaaccggctgtcaaacgggcggagaagaacgcttcaggccatacactctatatcgaagatgcgaaatccaacggtaaaaaaacggcttattacgccatttaccgcgcagaaaagggaaagcagccttatttagtggatacagtcagaaaaacatcgtcacggacgcagacattttcagatactgttattcgggcggaagaagcatgcacctatatcgttacttccgttgacaggcttcaccatgagagccgtccctccgcaaaacggacgattaaatagccattattaataaaactgacagttgcggcactgtcagtttttttttgcggcggatgagtccgaatgttcagactttatttggatggaatgaataaagacccccattaataaaatgtagaaagcagcagaaggaggaaggttaatgaattttcaactgacaaaagaacagcagatggtgcgcgaaatggtcagagatttcgccaaaaatgaaattgccccgaaagcccatgaggttgatcaatcagccgtcttcccgatagacacatttaaaaaaataggcgaactcgggctgctcggaattccgtttccggaagaatacggcggggcgggcggtgacaccatttcatatgcagcagcggtcgaagaaatcggaaaagcctgcggcagcacggggctgagctacgcggcagccgtgtcactcggcgcaagcccattatactatttcggtactgaacagcaaaagcaagaacatcttgttccgcttgcttcgggaaaagcgctcggatcattcgggctgacagagccgaatgccggttcagatgccggcggcacccagacaaaagccgagaaaaagggcgatgactatgtgataaacggagaaaaatgctggatcacaaacgcaaattacgcccgcacggtcattgtcaccgccgttacgggaaagaactccgccggaaaaccgatcatttcagctctcatcgtcccgacagacacaccgggatttacgatcacaaatccgtacgacaagatgggtgtgagaggatcggatacggccgagcttgtgctggaggatgtcagggtgcctgccgataacctgctcggtgatcctgaaaaaggttttaaacaatttttatatacattagacggcgggcggatctcgattgcggcactggctgtcggtatcgctcaaggcgcactggaggcgtcgctgtcatatgcgaaggaacgcaagcagttcggcagtccgatatcgtcatttcaagccattcaatttaagctggccgatatggcgatggaaattgaccttgccagacaaatggtgcttaaagcggcatggctgaaggatcaaaacctgccatttacgaaagaagcggcattcgccaagctttatgcttcagaaatggccgtcagaacctgccttcaggccatccaaattcatggcggttccggttatatgaaggaatgcggtgtcgaacgtatgcttcgtgacgcaaagctgatggagattggagaaggaacatcagaaattcaaagaatggtcatcgcaagacagcttttgaagtgaaatgaaaacgtttactaagacagggatggaagggggcaggtcatatggctgaacttatccatttaacagccggaaagctgcttgagcggaccgcggagctttttccggatcatgaagcggttgtttaccctgagcgcggccttcgttatacgtatgccgagtttgaccggttatgccggcaaaccgcaaaagggctgatgaaactgggaattgaaaaaggagatcatgtggccatatgggcatccaacataccggaatggctcgcggcgcaatttgcaacggcgaaaatcggcgctgttctggtcaccattaatacaaattttcaaatcgcagaactcgattacctgctggcgcattcagacgtctcggccctgataatcatggattcctaccggcagacatcttatgttgagatggtgaataagctgattccggagctgaaaacttgtgagcacggcaggctgcgttcgaaacgttacccctttttacggacggtgttatatatcggtgataaaagtccgcccgggatgcaccgctgggattctttgctgaaggaaggcgaagctgtaacggatgcagcgcttgacggaaggatggacagcctgaaaaaggatgattgcattcatatgcaatatacatcaggtacgaccggatttccgaaaggcgtcatgctctcacattttaatatcgtaaataacgcggccaatatcgcagaatgcatgaagcttacttcaagtgaccgtttatgtattcccgtgccgtttttccactgcttcgggtgtgtgcttggcgtgctggcatgtgtttccgcgggtgcggcgatgattccgatcgaacagttttctccaccggccgttctgaaaacggtggagcaagaagcctgcacggctctgcacggtgtaccgacgatgtttatcgccctcctaaatgacagccgcttttctgaatatgatctttcccacgtccgaaccgggattatggcaggctcgccatgcccggcggaagtcatgagagaagtgatcggcaaaatggggatgaccggcattaccattgcctacggacagaccgaagcatcacctgtcattacgcagacaagaacggatgattcatttgaaagaagagtggaaacagcggggcgcgcgcttccccatatcgaagtcagaatcgttcggcccggaacatcccaagaagccgaccggggcgaacaaggagagctctgcacccgcggatatcatgtcatgaaaggttactataaaaatcaagaagcgaccgaagaagcgatagacaaggacggctggctgcataccggtgatttggctgtcatggacgaggacgggtactgcaaaatcacgggccgtctgaaagacatgctgatcaggggcggcgaaaatatctatccgcgcgagattgaggaaatgttatatcggcatcccgcagtggcagacgttcaggtcgtcggcgtgcctgatccgaaatacggagaagaggccgcggcgtgggtcaggctcaaagacggacaaaccgcttccgcagaagacatcagaaccttttgcaaagaacatatcgcccgctataaagtccccaggtatgttttgtttacagatgaatatccaatgacagcctcaggaaaaattcagaaattcaagctgcgggaaaaaacgattgaagagctcaagttaacttaatgaaaaaggagtgcttcacatttgtttaaaaaagtcctgattgccaacagaggagaaatcgccttaagaattatccgcacctgcaaacgtctcggcatcccctcggcagctgtgtattcagaagccgacagggacgcgctgcatgtaaaagcggctgatgaggcctatccgatcggtaaatcgagagtaaatgaaagctatttacatatcgacagaatcatagaagccgccaaatccgccggagcggacgccattcatccgggctacgggctgctgtcagaaaacagcctgttcgccgaacgctgccggaaggaacaaatcacatttatcggcccgcccggtgatatcatcgccaagatgggcagcaagatagaagcccgaaaaacgatgcaaaaagcaaaggtcccgatcgttcccggtgtttcagagccattgcccgatgttcactccgccttagccgaagcccgtgccatcggctttccggttatgctgaaagcgtctgcagggggaggcggaatcggcatgcagatcgtacattcagaagaagagctggccaaagcgttcgaaggcaatcaaaagcgggccgcgtccttttttggagacggcgcaatgtatatggaaaaggtcattgaaaatgcccgtcatattgaaattcagattctcgcagattctttcggcaacaccgttcatctgtttgaacgtgactgttcagtacaaaggcgccaccaaaaagtgatagaagaagcgccgtcgccgtttgttgacgatgaattaagacaaagactcggtgaaaccgccgttaaagccgctaaatcgatcggctaccaaaatgcaggcacaatagaatttctcgtcgaccaaaagaaacaaatctattttttagagatgaacacaagactgcaggtggagcatccggtgacagaagaaattacaggactggatcttgtggaagaacagctgaaaatcgccgccgggcaggcgctgactttctcgcagaaagatatcaaccaccgcggtcatgcgatagaagtgcggatctatgcggaagatccggtcaccttttacccgtcacccggtaccatctcgtctttttccgttttaagacacccgtcagtgcgacacgaatgcgccgtcgaaaagggaagcgtcatttctccgttttacgatccgatgattgccaaaatgatcgtcacggcgaatacgagaaaacaagccattgaacaactgaaaaccgcccttggcgaatatcatgtagaagggattaaaaccaacattccgctgcttacaaaaattgcacattcagaagtgtttgaaaagggtgaggcaacaaccggttttttacaaacaatgaacgagggggcgtcaaaatgagcgtcataaaaattcagatggcgggaaacctgtggaaaattcatgtgaagcccggtgatgtcattgaagaaggacaggaagtggccatcttggaatctatgaaaatggaaattccgattatcgctgatgcagcgggtacggtgaaagaagtgaaaaaatcagaaggtgatttcactgatgaaggagaggtcctgattgaacttcaataaaacgggaggtgcagcatgaactgtccggaatatgtccgcatcaatgaagtaggaccgcgtgacggcttgcagaatgaatcggcgtgggtggatacagaagataagattgagtggatcaatatgctgtcaaaaacaggccttccctatatcgaagtgacatcattcgtgcatccgagatggattccggctcttcgtgacagcctggacgtcgcaaaaggcattgccaggtctgaacatacggtctacgcggcgctcgttccgaacctcatcggactggagcatgcggcagaaggcggaatcgatcaggcctgtgtatttttatctgcaagcgaaacccataaccaaaaaaacgtaaacaaaccgattgaccggaccgttcaagagctcaggcgggttattactgaagcaaaagctgaaaaaatggcgacgagagcttatctgtccactgtgttcggctgtccgtacgaacagaacgtgccggtcgaacaagtcatccgcctgtcagacacactgctcgaaatgggtgttgatgaaatatcgctcggcgacacgatcggcgcggcaaaccccttgcaggtcatatccgtgcttgaagcccttttgccgagaattcccgcctcaaaaatcgcactccatttccatgatacaagaggaacggctctagcgaatatcattcccgctcttgatatggggattacatccttcgatacttcctcaggcgggcttggcggctgcccgtacgcccctggatcagcaggcaacgctgccacagaagacgtcatttatatgctcgaacaaatggggattgataccgggacggacatgaataaacttcttgatgccgcccgctggatcgcggataaaataggcaaagatctgccaagcagaaatctgcaggcattcagaacgaaatgagaaaggagaagccatgggagattgcgtcttgtattccgtctgtcaagaaacgatcggtctgatcacgctgaaccgcccgcatgcggccaactcgctgtcttcagaaatgattgatcatttacagcgtgtgattgaagacatcaaaaactcgccatccattcgctgtgttattctcaccggctccggaaacacattttgcgccggcgctgatttaaaagaaagagctgggatgaatcatgaacaagttaagcaaagcgtcaggcgtatcggtgaaacggctgcatccattgaagctctcccgcagccggtcattgcagcgctgaacggaaccgctgtcggaggaggccttgaactcgctctcgcctgcgatatcagaacagccgtcagccgggcgggcctcggccttcctgaaacagggcttgcaatcattcccggggcgggcggaacgcagagactgccccggcttatcggccccggcgcggcaaaagaattgatctataccggccgaaggctttctgccgaagagggaaaagacatgaagctgatcgagcatgtttgtgaagccgatgaacttatggaaaaagcaaaagcactggccggccgcatcgccgctaatgggccgatcgccgtcagacaagcaaaatccgcgataaacaagggtctggagacagatctcaatacagggctcgaaatcgaacgaaaagcatatgaacaagtcatccctacacttgacagagaagagggcctgcgcgcttttaaagaaaaaagaccccctgaatacaaaggaaaataaaacatggagggactcggatggattacgaaaaagaacggcagacacgcagcaaaacgattgaaaagggaggagccgcgaaatatcatgcaagcaacgaaaagaagggaaaactttttgtaagagacaggctgaagcttttattcgatgacggcatatccgttgaagacgcttttttcgccgagtgcatgtcagacggactgccggctgacggggtcgttaccgggatcggaaccatcggcggcagaaccgtttgtgtgatggcaaacgactcaaccgtaaaggcgggctcgtggggcgcgaaaacggtggaaaaaatcatccgcattcaggagacggcggagaagcttcagtgtccgctcttgtacttagtcgattccgcaggtgcgagaattacggatcaggtcgacatgttcccgggcagaaggggagccggccgcatcttttataatcaagtaaagctgtcgggccgcattccgcaaatctgtttattgttcggtccttccgctgcgggcggcgcttacattccggccttttgcgacattgtcattatggtcgaaggcaatgcatccatgtacttaggttccccgcgcatggcagaaatggtgatcggcgagaaagtatcgcttgaagaaatgggcggcgcccgtatgcattgttctgtatcaggctgcggtgatctcctcgccccgacggaacaggaagcaatcatgatggcgcagacatatctcagctactttccggcaaattatactgaaaaagcgcccgtcaacaaatctaagaacccgaaagcttttgaaaaaccgctctcagatgtcatcccggcacatcaaaacgcaccgttcaacatgatggatttaattgaacgtgtcattgatgaagactcgttttttgagattaaaccgttatttgcgcaggaattaataacggggctcgcgcggattcacggacagccggtcggcattatcgccaatcagccgcgtgtcaaaggcggagttttatttctcgattcggcggataaagccgcaaaatttatcgctttgtgcgacgcattccatattccgcttctgtttttagcagacattcccggattcatgatcggaacgaaggtggagcaggcgggcatcatcaggcatggcgcaaaaatgatctccgcaatggcggaagcgactgttccgaagctttccgttatcgtcagaaaagcctacggtgccggattatacgcgatggcggggcctgcttttgaaccggactgctgtttagcgcttccgactgcgcaaattgccgtaatgggtcctgaagcagcggtgaatgcggtctacgcaaacaaaatcagcgagctggcccctgaagaaaggccggcttttattcaagaaaagcgtgatgaatataaggaagacattaacctttaccggcttgcctctgaaatggtgattgacggcattgttcctgctgattccttgcgggaagaactcaataaacgcctcactgcttacatgtccaaacaactgacattcacacaccggaaacaccccgtatacccggtataaataaaaaaagactgcatagatccggctcgcagccgttcttatgcagtcttttttcacagtcttgatctcattttcttcacaacaaaataaacaacaataaatacgagagccaatataatgatcggagttgtatacattccggcatagctgtctacgtctttccactgtcccccgagctgatacccgagataaacgaaaatgacagaccacggaataatggcaagcgtcgtcaatatgacaaacttggaaagaggcattttcgcaaggccggccgggatggaaatcgcatgtctgacgaccgggataaaccgcgccgagaacacaacgccggcgccgtaacggcgaaaccagttttccgcaacatcaacatgatgctttttcagaagtaagtacttgccgtacttgtccaaaaacggccgtcccccataacgggcgatccagtatataaagcactgcgcgatcgttcccccgatcacaccggcgacaatggcgccgataaagctgatcgtgccttctgacaccatatagcctccgtaagccagaacgatttcactcggaatgatttcgatcattaatccgagcgcaatccctaaatagcccatacttgtcagccaggataatatttcactaataaaattgcccacactgttcacaacctctttatctttttacccaattatatgactgattgacaagcaaaatggttacaaattattttttaacgcacgatttcttcagattctctttttaacacctcttctaaataagctaaaagtttcggtctcatttcttcccgcagaagcccgatctccgtgccggccttaaaacagccgaacttatctcctatatcaaaccggcttccttcaagctcccgcgcgtaaatgcttcgggtgcggcatacttcgcgcagcgcgtctgtcaattggatttcgctgcccgcgcctcttccgatcgtcttcagcgctttaaaaatggcaggggttaatatgtaacggcccaacacggcaatatgagagggcgccttttcaacggccggtttctcaatcagatcctcaacccggtacacatgaccgctctgccgccccgtctgtataataccatatttgctgacatcagcaggatcgacgggctgtacgccgatcgtttctgtgccgtgttggttatagacgtctatgagctgtgaaagagcgggagtgtcagataccataatatcatcacctaatagaacggcaaaaggctcatctccgataaaatgctccgcacacagcaccgcatggcctagtccgagcggttctttctgacggatgtaatgaatattggccaaatcggcaatccgctgcatttccttcagtgtctctgacttgcctttttccttaagattgatttccaactccgccgaccggtcaaaatgatcttcaatcgagcgtttgtttctccctgtaataatcagtatatcttcaattcctgactctcttgcttcttcgacaatgtactggatggccggtttgtcgacgatcggcagcatttctttcggctgcgcctttgtcgccggcagaaatctcgttcctaaacccgctgcggggatgaccgcttttctcactttttttctcattcatcttcactcctgatcctgtatgtttttcagcgaatctccaaatacccagattcggtttccgataaaattcatcatcattccgccgatagtggcggcgagcttactcaccaaaagcgaacagccgcctttttgaaacgcgtacagcagcaaaaaggtgattcccgacgctgcaagattaatgatgagaaagcgcacgatctctttcccgtcagccttgtgttttacacgaaacgtccacttccggttccacacatagctgttgatgatccctgccgaataggagcagatctgcgccggcagataggggacaaggcaagcggtgagaagaaagaagacaccaaaatcgatcagcgtattgccggcgcccacggtgcaaaaacggcctgctgtctttactttttctttcagcataacggcatccggttttgacctcccttcataagtaagatgcggatcgctgtcctatttgttgatatggattactttagcggacagtgttgaataaacaattactaaaatatgaacaaaacatgaaaacgtaatgaggctttgtaaaacccattaagttaacagttttatattttaggttgacatattacgtgcaagacactaatattctgtattagtgttaaccttttattattttggttaacattaaatttcgaaataaaagaaaggagggaaatttcatgcaggaagagacctattacagcgtcagaatgagagcttcccgaaacgccccccatgagcagggcggaaaacatatttccggcggagaacggctcatcacttacagcggtttacaggaagcggtagatggcttattacataaaggcttctcacactcaagagggatacctgattttatgcagattcagcttgaaagcgttcatgaaccgatcgaaacgatccgccctttgccggttgccctccatcaaacagacacgccggaaaaaggacaagcaatcgcccgcaagcttctgcaaaaggcggggattcctccgcacatgatcgagaaagcgtacgaaaacatttcggaatatgcagaagcaagaggagcggtcctgtttgatatccgggcaggaaaacgcattgactgcagagggaatagaggtgtgcgggtatcccgagtggattggccgtcacctgattttcaaaaatgggcttttactcacaacatgccggaaaattcacgaataaaagaagcacatgccatcgcggcaaaagtttgcgcacatccgggaattattgccgaattgtgctggtcagatgaccctgattacataacaggttacgttgctgcaaagaagctgggatatcagcggattgccaagatgaagaatgccggagatgaaagcggatgccgggttttctttactgatggctccatagatacggagagctgtatccattttttagagaagcagcctgtattcattcagcgggaggagaacatatgaaacaatcaatgattgaaaaaagcaaacagcatctttggctgcctttcacacaaatgaaagattacgatgaagatccgttcatcattgaaagcggaaacgggatcatgctgaaagacatcagcggaaaagaatattatgacggcttttcttcagtatggctcaatgtacacggccaccgcaaaaaagaaatggatgaagcgattcaaaaacagcttgaaaaaatcgctcattcgactttgctgggtatgacgaacgttcccgcaacagaacttgccgagatgctgacgggcatcacaccggaaaagctgacgcgcgttttttattccgacagcggagcggaagcaatggaaatcgctctgaaaatggcctttcaatactggaaaaacgtagggagacctaagaagcagacgtttatttcgatgcagaacggctatcacggcgatacaatcggagccgtcagcgtcggctccattgaactcttccaccatgtgtacggcccgctgatgtttgaaagctacaaagccccgattccttatgtatacagatctgaaagcggtgaccccgtacagtgccgggatgaatgccttcacgcgctcgaacagctgcttgcaaagcaccacgaagagattgccgcacttacgattgaatcgatggtgcaaggcgcatccgggatgatcgtcatgcctgaaggctttctggcaggcgtacgaaagctgtgtacggcatatgatgtgttaatgatcgttgacgaagtggcgacggggttcggccgcaccggaaaaatgtttgcctgtgagcatgaaaacgtccagccggacttgatggcggcagggaaaggcattacgggaggctatttgccgatcgctgtgacgtttgccacagaagccatttatgaagccttctacgatgactacgacaaaatgaaaacatttttccacggccattcctatacaggaaatcagcttggctgtgccgcggcaattgaaaatctgcgtttattcgaatcagagcgcatcgttgaacgagtcgccgaaaaatcaaaaacggctgcggaatttcttcatgatctgaagctgcttcctcatgtcggcgatgtccgccagctcggtttgatgtgcggcatagagcttgtgcaggataaggggacaaaacagccttatccgcctgaaaagcggatgggatacaaggtgtccttgaaaatgagagagctgggtatgctgacacggccgctcggtgacgtcatcgcctttcttccgccgctcgccagcacaaccgaccaattacaagccatgatctccattatgaaagaagcgatagccgaggtgaccggccgtggattttgacggatggctcctcggaaggctcgatgcggtgaaaagagacgggctgtatcggacgctgcgaacacaggaaaccgctcttaaaaccaaggggcaaaagcggcagacctgggcgtccaatgactatttaggtctgtcaaaagatgaacggctgatcacagccgcgcaaacagcgctgagccggttcggagcgggaagcggcggctcacggttaacgacaggaaatactgtgtggcacgaaaaacttgagcaaaaaatctccgactttaaacagacggaagcggctttattattttcaagcggttacttggcgaatatcggcgtgcttgcctcactgcctcaaaaaggcgatgtcattttaagcgatcaactgaaccatgcgagcattgttgacggctgccgtttatcaaaagcggaaaccatcgtgtaccgccatattgatatggctgatcttgagaaaaaacttgcctccgtccagactcggaaccgccgctttatcgtcacagacggcgttttcagcatggacggcaccatcgcgcctcttgaccgaataatgccgcttgcaaagcagtaccaggcatttgtgatagcagatgacgcgcatgcaaccggtatactcggggaaaacggcggaggaaccagtgactatttcggtgtttgtcctgatgttgtcatcggcacattaagcaaagctgtaggaacggaaggcggttttgccgcgggatcaaacatttttattgattttttgctgaatcaggcgcggacgtttatttttcagacggccctcccgccgtcaatttgtgcggcttcgcatacggcatttgacctcatatcagatatgcacgatacgcgccgtgagctgcagtcgtctgtcaaaaagataaaaacgcgtctggccgatatgggctttactgtaagaggcggagatacaccgattatccccgttatcatcggtgatgcaaaaacagcggtttcagccgctgcgctgcttgagaaaaagggaatctgcgccccggccatccgcccgcccgccgttccggaaggcgaaagcagaatcaggctgaccgttacggcggatcgcagcttacaggacatagacgagctgacggaagcatttgattccattagaaaagagctgaatataaacaaatgagaagtttttttgtcacaggaacagataccggcgtcggaaaaaccatcgtttcttgcggacttgccgcggcattcaggcagaaacaggcggatatcggagtgtttaaaccgtttttaagcggcgtgccgcggactcatccggaaagtgacacctcgctgttgaaaaacatgtcacaaaccgcactgtctcatgaagaaatcacgccatttgaatggaaagagccgcttgcgccgtacacggccgccatgcttgaggggaaatccgtgagcatggatgaagtcatggcccactggagtaagatcaaaaatcgtcatgagtgtttcatcgtcgagggggcaggcggcatttccgttccgcttggtgaaaattacttagtcagtgatttgataaaagccttggaattaccggcagtgattgtcgccaggcctgatctcggaaccatcaaccacacatatttaaccgttgaatatgcgaaaaacatgggaatagaggttctcggtattattatcaacggcgtaaagagccggccggggctggacgagaagacaaacccgagcatgattgaaacattatgcaaagttccgattttgggaatcacaccgaagctggatcacgtttcaccggaaaacattcaacacatgattgagaaacatatagatgtttcctctttcatgaatctgacacaaatggggagataaacatgaatcaatggatggatcttgcagagagagttctggacggggcggaagtaacgaatcaagaagcgctggccattttaaattgtcctgatgaggatcttttattgctgatgcatgccgcttttcatatcagaaaacgattttacggaaaaaaagtaaagctgaatatgattatgaatgcaaaatcaggcctgtgtccggaaaattgcgggtactgttcacaatcttcaatatcaaaagcgccgatcgagtcttatcggatggtggataagcatatattgcttaagggggcaaaacgcgcccatgacttgaatatagggacatactgcatcgtcgccagcgggcggggaccgtcaaacagagaagtagatcaagttgttgatgctgtcaaagaaattaaagaaacttacggtttaaaaatctgcgcatgcctcggtctgctgaagccggaacaggcagagcgcctgaaacaggcaggagtagaccggtacaatcataacatcaatacatcacaaaggaatcactcaaacattacgacttcccacacgtatgacgacagggtcaatacagtggaaacggcgaaacaatcggggatgtcgccttgttcgggtgtcatcgtcggcatgaaagaaacgaaacaggacgtcattgatatggcgaacagcttaaaagcgcttgacgccgacagcatcccggttaattttctgcatgcgattgacggaactccgttagaaggggtaagcgaattacatccggtgtattgcctgaaagtgctcgccttgttccgttttatcaatccgacaaaagaaatccgtatctcaggaggccgggaagtcaaccttcgttcgctgcagccgctgggactttacgccgcaaattcgattttcgtcggagattacttaacgacagcagggcagcatgaaacagaggatcatcaaatgctccatgatttagggtttgaagtcgaatccgttgaagaaatgaaagccggcctgcaatccgcctgcaatacggaggtataagatgacggcgggcctatcgactgcacatccgtccctccatgcggattcggatttttggaatgacccttacccgttttatgaaaaactgcgtgccattgatcctgtttataaaggaaccgtattaaaacatccgggctggtatgtcaccgggtataaagaagcggcagcgattttgaaagacacccggtttaaaaaccgcgtcccttttccggaagcttcaacgaaatatcaaaatctatctcatatccagcacgatatgctgttatttaaaaatcaatcagaccataagcggatgcggatgcttataggtaaagaatttaccgcaaagacggcggaatcacttcgcccctgtataaaagaaacggttcatgacttgttggatcaaatccaaaacaaaaaaaacgcagaccttgtttcagagtttgcctttccattggcaagcctcatcattgcggagatactcggagtgccgaaagaggagagatatcaattcagacaatggacggcagacgtcattcaggccattgatcttacccggtcaagaaagatgttagtcagagcaagcgacaccgcaggcaggctgactgcatatttcagagatttgattcacgagcggaaagcacatcctcaggaagacttaatcagcaggtttattatgggggaacagctttcaaaagacgaagtgctcgcgacatgtatcttacttgtcatagccggacacgagacgacggtaaacctcatgagcaacggtgtgtttactttattgaaacaccctgaacagcttagcgcactgagagaaaacccctcgcttattgaaactgctgtcgaggaatgtctgcgctacgacagccccgcgcagctgacggcacgcaccgcttcagaagactgtgaaataaatgggaagaccataaaaaaaggagagcaggtatatatccttttaggggcagccaatcgcgatccaagcatattcgatcagcctcataaaatggacatccaaagaaaaccgaatccgcatcttgcattcggaaagaacgcccatttttgcataggctcctcattagcgcgcatcgaagcacaaattgcaattctcacactgtttgagcggatgcctaagcttcggctggccgcacaccgccttgaataccgcaagctcattggttttaggtcgctcaaagagcttccggttgtccttggctgaatgaccatgcaggagggccggattttatcggttcctcttgcaggaaataaatgaaagaaaaaagaatacatatttataaagcaaaaatcctctctgatccatctcactatccctaaaaaaactcgctgctcagccattcaatatcatacagcaagaatctccttttctttcgccaaaacggaaaattcaccatgatgcacattttttcagcctcagaaacggtgcaaaatcggcatgttttctgctttattttcttgatctttgtaagcgcttactaatattgagcagaaaagagggggatttgtggacattgttattattttattggcattaggcatgctgatgtttgcggcttaccggggcttttcagtcattttattcgccccgatttgtgcgctgtttgccgtgctcctgacagatccaagcttcgtacttcctttcttctcgaatatatttatggagaagatggtaggatttattaagctgtattttcccgtatttcttttaggggccgtttttggcaaggttgttgaaatatccgggctcgccgagtcgattgcaaaaacaatcgtcaggcttgtgggagcaaaaagagccattctcgccatcgtcttaatgggtgcgattttaacgtacagcggcgtcagtctcttcgtagcggtgtttgccatttatccgtttgctaaaaacctatttattaaagctgatattcccaagcgtctgatacccggtacgattgcattgggcgcgtttacttttacaatggatgcgcttcccggcacaccgcaaattcaaaatgtcattccgacagctttttttaaaacaaacatttatgccgctccctggctcggactgattggcgcagcatttgtgcttacggccggaatgatttatttagaatcccggcgcaaaaaagcggccaatgccggagaaggctatgctggatttcaatctgaagtttccgctgcagaggattcctcaagtctggctaatgaaaaacatacgcctgttttaccgcaggaggcagaacccagccccgcgcggcaagtgctcgcctttgttccgcttatccttgtggggatcatgaacaaatgcttcacgatgtggctcccgcattggtaccctgacggatttgattttgcgcagctcggtttaaaagcgttcgggaagattgacctttcctccgtcactgcgatctggtcagtagaactcgcactgctcatcggaatcatgacaacgattttgttcgattggaaaaaagtgctcttcaatttgaaagaaggactgaatgagggcatcgggggtgccttgctggcgtcgatgaatacaggagccgaatacggatttggcggcatcattgcggcgcttcccggctttaaaatggtcagcagcggcatatcgcagacgtttactgatccgctcgtcaacggagcggtgacgaccactgcgcttgccgggattacaggatcggcatcaggaggaatgggcatcgctttaagcacgatgtcagcagcatatacagaagcaatcaatacattccacattccgccggaggtcatgcaccgggtgatttcgatggcctccggcggaatggacactcttccgcataatggcgccgtcattacgctgctcgcggtcaccgggttgacccaccgccaatcctacagggatatctttgccattaccgtcattaaaacagcagctgtgtttgtcatcatcgccatttacagtctgacgggccttgtgtagccaaaacagaaaggggaaacgaatatgggaaaaggaaaagtgatggactcttataaagatgctgctgcactgatcaaggatggagacaccctcatcgcaggaggcttcggcctgtgcggcattccggaacaattaattctcgcgatcagggacagcggcgtgaaaaacttgaccgttgtcagtaataactgcggtgttgatgattgggggttaggcctcttgcttgcaaaccggcagatcaaaaaaatggtcgcatcctatgtcggagaaaacaaaacctttgaacggcagtttttaagcggggagctggaagtcgaattggtgccccaaggaacgctcgcagaaagaattcgcgcgggaggggcgggcattccggcgttttatacacctgcgggcgtcggaacatcagtagccgagggaaaagaacataagacatttgacgggcgcacctatcttctggagaaagggattacagggaacgccgccatcataaaggcctggaaagccgatcctctgggcaacctgatgttcagaaagacggcgagaaatttcaatccgctcgctgcaatggcaggcaaagtgacgattgcagaggctgaagaaatcgtcgatgccggagagcttgatccggatcaaattcatacgccgggtatttttgtgcagcatgtgctgcttggcgggattcatgaaaaacggattgaacgccgcaccgtccggcaagcatgataaaggaggctgacagaatgagagatagcagaaaacgaatgatcaaacgggctgtaaaggaaataaaggacggaatgaatgtgaacttggggatagggatgccgacgcttgtagccaatgagataccgaatgattataacgtcctgcttcagtctgaaaacggcttgctcgggatcgggccttatccggcggaaggaacggaggaccccgatctgatcaatgcgggaaaagaaaccattaccgaggtaaagggagcctcgtattttgacagtgccgaatcctttgccatgattcgcggcggccacattgatgtagcgattctcggcgggatggaagtgtccgaacggggagatttggcgaactggatgatccccggaaaaatgatcaaaggaatgggcggcgccatggacctggtgcacggagcaaaacggattattgtcattatggagcatgttaataaatatggggaatctaaagtgagaacggaatgtacgctgcctttaaccggcaggcaggtggtcgatcggctgatcacagatttggctgtattcgattttcatgatggccgtatgacgctcaccgaactgcaggaaggtgtaacaatggaggaggtctttgagaaaacagaaggtcattttactgtcagccagtcgttaaaaaacggggtcagaccaaaatgaggaggtgccgccatggattcattgcttattgaaaaaacagccgttgtaacaggagcagccggaggaatcgggcttgaaattgcaagagaattcgcccgtgaaggagcagccgtcatcatctctgatgtaaacgaacaagcggggaaagaagcggcggcaggacttaaagatgaaggctgtgaagcagtcagcatcacatgcgatgtaacaaatgaaaagcaagtggccgacatgctgcagacggtcgagaaacaattcggacgtctcgatatccttgtgaataatgcgggcattcagcatgtcgcgcccatcgaggaatttcccaccgaacagtttgaacggctcattcgtgtcatgctgactgcgccatttatcgcaatgaagcatgcattccccattatgaaaaaacagcaattcggtcgaatcattaatatggcgtctgtcaacgggctgatcggttttcacgggaaagcggcatataacagcgccaagcacggcgtcatcggtttaacgaaagtcggtgcacttgaaggcgcggctgacggcattaccgtcaatgcgctttgtccgggatatgtggacactcagcttgtccgcaatcagttaaaggacatttccgcaacaaggaatgtaccgtacgagcgggtgcttgaggacgtcatctttccgctcgttccccaaaaacggctgctgtcagtgaaggaaatcgctgattacgctgtatttttggccagcgacaaagcaaaaggggttacaggtcaggccgtagtcatggatggcgggtataccgctcaatagttcttatatttttttaaaaacagccgctctgaacggctgtttttttatgcctgaaaaacttgttcactcaataggccgatttactgcccaaccggtatccgggctgggtcattcacatgttctgcggcgtattttgtccttgcagatttttctcatccagatccatttctgcgccgcatttataatcaagcgccatcagtttacaatccttcacagatatacaaatgaatttttacaataaacataaaatatgtaatttctgacacaataatgccaatagccctaaaacatatgaaacatgaagagcgcgacctaagtgatgaagagccggtaacaggctccactccggcttttcatcatctctctttaagactgattttcggtgaaaccccatgttttattttatgaataaatatatctaattcgtttgtaaaatcgaacaataactcctccgaaagtattctatacacatttgttataatcatgctaggatgttagataaagggataatttgtaggatattgtatttctgttcaatatgatcggaggaatctcatgaacaatcttgcctttttatttcctggacaagggtctcaatttgtaggaatgggcaaacaattttggaatgattttgtgctcgcaaagagattgtttgaagaagcgagcgatgcgatctccttggatgtaaaaaaactgtgttttaacggagatatgaatgaattgacaaagacaatgaacgcgcagcccgctattttaacggtcagtgttattgcttttcaagtgtatatgcaggaaataggggtgaagccccgcttcctggcaggtcatagcttaggcgaatattcagcgcttgtctgtgccggcgccctttcttttcaggatgccgttacacttgtaaggcagcggggaattcttatgcaaaatgcggatcctcagcagcaggggacgatggccgccgtgactcacctctctcttcaaacgttgcaggaaatatgttcgaaagtgtcgacggaagactttccggcaggagtagcctgcatgaattcagaacagcagcatgtgatttccggacaccggcaagctgtggaacgtgtcatcaagatggcggaggaaaagggagcggcatacacttatttgaatgtcagtgcgccttttcacagttcgctgatacgatcagcatctgaacaattccagactgtattacaccggtattccttccgggatgccgcatggccgatcatttcaaatgtcaccgcacgcccttacagcagcggaaattcgatcagcgaacatctcaagcagcacatgacgatgccggtaagatggacggaatcgatgcattacttgcttttacacggagtcacagaagtcatcgaaatgggtccgaacaatgttttagccggtctgctgagaaaaacaacgaatcacattgtaccttatcccttaggacagacatctgatgttcacttgctttccaattcagcggaaagaaagaaacatattgtccgtttacgcaaaaaacaactgaataaattgatgattcaatccgtcattgcgcgaaattacaacaaggattcagcggcttattccaatatgacgacggcattatttacgcaaatccaagagctgaaagagagaatggaaagacatgaaaatgagctctcagaacaagagctcaaccattcgatccatttatgcaaattaatttgtgaagctaaacagcttccggcttgggaagaattgcggattttaaaataaagcgcccaggaggggacctatgtataccagtcaattccaaaccttagtagaagtcattcgggaaagaagcaatatctctgatcgcgggatccgttttatcgaatccgataaaaacgagacggttgtctcttatcgccaattgtttgaagaggcgcaagggtatcttggctatttacagcatctcggcattaagccgaagcaggaaattgtatttcaaatccaagaaaacaaatcatttgtcgttgctttttgggcttgtatattaggaggaatgatcccggtgccggtcagtatcggagaagatgatgaccataagctgaaggtctggcgcatttggaatatattaaatcatccgtttctgattgcctctgaaaaagtattggacaaaataaagaaatacgctgcagaacacgatttacaggatttccatcatcaattaaacgaaaaatctgacatcattcaagatcaaacctacgattaccccgcttcgttttatgaacctgatgcggatgaactcgcctttatccaattttcttcaggatcgacaggagatccaaaaggagtcatgttaacgcatcacaacttaatacataacacgtgcgccattgggaatgccctagccgttcattcgaaagactctttcttatcatggatgcctttaacgcatgatatggggctcatcgcctgccaccttgttcccttcataaccggaatcaatcaaaatctaatgcctacagaattatttattcgcagacctattctttggatgaaaaaagctcatgaacataaagccagtattctatcctctcctaatttcgggtacaactacttccttaaatttctgaaaaacgaaccagactgggatttatcccacatcaaggtcatcgcaaacggtgcagaaccgatattgccggagctctgtgacgaatttttgaaaagatgcgcagcattcaatctgaaaagatccgccattttgaatgtttacggtttagcggaagcttcggtcggcgcagcattctctaaattaggtaaagaattcgttcccgtttatttgcatcgtgactatttaaatcttggtgaaagagctgtaaacgtcagcaaagaggatcaaaattgcgcttcattcgtcgaagtgggacgacctattgactattgtcagcttcggatctccgatgaagcaaatgaaagagtagaagacggaatcatcggccatatccagatcaaaggagacaatgtgactcaagggtattataacaaccccgagagtacggaaaaagcgctgacttctgacggctgggtaaaaacgggagacctcggattcattagtgaaagtggtaacttagtcgtaacgggaagagaaaaggacattattttcgtgaacggaaaaaatatctacccgcacgatattgaacgggtcgcgattgaaatggaagaggttgacttaggaagggttgccgcctgcggtgtatatgatcaaaagacacaaagcggagaaatcgtgctctttgttgtttacaaaaaatcacctgaaaaattcgcaccgcttgtcaaagagataaaaaagcatttgctcaagcggggcggctggagcataaaagatgtccttccgatccgaaaactccctaaaacaaccagcggaaaggttaaacgctacgaacttgccagacagtatgaggcagggaatttttcaacagagtctgccgccatcaatgaatatttggagagcagcccggaaacgtccggacagactcccattcatgaaattgaaacggaattactgtctatcttttccgatgtgctcaatgggaaaaaggttcacctcgctgacagttattttgatatgggagcaaattcattacagttatcgcagattgccgagcgcatagaacagaaattcggacgcgagcttgccgtttcagatctctttacgtatccttctatcactgatttagcggcatatctgtctgaaagccgggctgaaatcaagcaggacgtggcagcgaaaccaagccacgtgacgccgaaagatatcgccattatcgggatgtcgctcaatgtccctggagcatcaactaaaaatgatttttggaatctgcttgaaaaaggtgagcacagcattcgagaataccctgcatcccggctgaaagatgcggcggattatttaaagtccatccaaagcgaaatcaatgagaatcagtttgtgaagggcggctatttagatgaaatcgaccgctttgattactcgttcttcggtttagctcctaaaacggctcagtttatggaccctaaccaaagactgtttttgcagtctgcatggcatgcgattgaagatgcgggctatgccggcggcagcatgaacgggagccgtgtcggggtatatgcagggtactcgaaggtgggctacgattatgaacgtctcctttctgcgaattatccggaggagcttcatcaatatatcgtgggcaatctcccttccgtgttagccagccgaatcgcttatttcttaaatttaaaagggccggcggtgacagtcgatacggcgtgctcctcatcgcttgccgccgttcatatggcatgtaaatctttaatatccggcgattgtgaaatggctcttgccggcggtatccggacatcgctcttgccgatctgtatcggacttgatatggaatcttcggacgggtacacgaaaacgttcagcaaagattcagacggtactggcacaggtgaaggcgcggccgcagtcctgctgaaacctctgcaggatgctgttcgcgacggagaccatatttacggcgtaatcaagggaagcgcgttgaatcaagacggaacaaccgccgggattacagcaccgaatccggcagctcagactgaggtcattgagacggcctggaaagacgcgggcattgcccctgaaacactgtctttcatcgaagcgcatggcaccggaacgaagctcggcgatccggttgaatttaacgggctttgtaaagcgtttgaaaagtatacggcaaaaaaacaattttgtgcgattggttctgttaaatcgaacatcggtcatttgtttgaagcggcaggcatcgtcgggctgatcaaatctgtcctcatgctgaatcacaagaaaaatccgccgttagtgcactttaatgaacctaatccgctcattcattttcactcttcaccattttacgtaaaccaggaagctgcagcgttcccatccggtgatgagccgctgcgaggcggagtcagctcatttggctttagcggaacgaacgctcatgtggtattggaagaatatatttctcaaagtgagtatgcgcccgaggatgaacatgggccgcacctatttgttttatccgctcatactgaaaaatcactctatgaactcgcacagcagtaccggcaatatgtatcggatgacagccaagcttcattaaagtccatttgctatacagccagtacgggcaggactcatttggatcatggcattgccatgattgtatccggtaaacaagaactatcggataagctgacccgcctgattcagggagacagaaaccttcccggtgtatacatcggctacaagaatatgaaggaaatgctgcccgctcataaagaagagctgaataaacaagcagccgcactgattaagcagcgtttacgtacgcaagatgaacggatcacatggctgcatcgcgccgccgaattatttgtgcaaggagccgttatcgattggcgcgcgctttattcaggtgaaactgtacaaaagacgccattgcccgtgtatccgtttgaacggagccgatgctgggctgaagctgaccaattgcgcttaaacgaggacgaaaagagaggagaagcggcattgaatatcaatcaatcgaagtcgcacattgaatccttcctgaaaactgtaatcagcaatgcttcggggatcagagcggaggaactcgatctgaatgctcattttatcgggctcggaatggattctatcatgctgtcacaggtcaaaaaagccatcgcggacgaatttggggcagacatcccaatggatcgtttttttgatacgatgaacaaccttcaaagtgtcatagattacttggctgagaccgttccatcgtcctttgcatccgctccgcctcaagagaatgttccggcgcaggaaatacaggtcatttcagaagcacagtctgaatcggatcgcagagaaggtcaacaagagcatatgcttgaaaaaataatcgcttctcagaatcaattaattcaggataccttgcaagctcaattaaatagctttaatttgttgagaaacagcggacatcattccgatgagaaagaatacgctaaagcgcaagagaaatcaattccttctgtcaagcaggggcctccggccgtcactgcagaaaagaaagcggctcaagaagcgaaaccctatgttcctttccagcctcagaacctgcatgaacagggacactataccgcacggcaaaaacaatacttagaagatttcatcaagaaatacgcagataaaacgaaaggttccaaacaatatacggacaacacccgatttgctcatgcaaacaaccgcaacttgtccagcttccgttcgtattggaaggaaatcgtatacccgattatcgccgaacgttctgacggttctaaaatgtgggatattgacggaaatgaatatatcgatgtcaccatgggattcggggttaaccttttcgggcatcatccttcctttattacacaggttatcgatgattcagcccgttcatcattgcctccgctcggcccgatgtcagatgtcgccggtgaagttgccgaccggatccgcacatgtaccggagtggaaagggtcgctttctataattccggaacagaggccgtcatggttgccctgcgtttggcgcgggcagcaacaggaagaaagaaagtcgtggcgttctcgggatcttatcacggcacgtttgacggcgtattaggggttgccggcacaaaaggcggagccgcgtctgcgaatccgctggctccgggtatactgcaaagctttatggatgatttgattattttacattataacaatcccgattcgctggacgtgatccgcagtcttggtgatgaattggcagccgtactggtggaaccggtacaaagccgcagaccggatttgcagccgcgggcatttttgaaagaattgcgggcgatcacgcagcaatccggaacagctctgattatggatgaaattattaccggatttcggatcggtctcggcggcgcacaggaatggttcggcattcaggctgatttagtgacctacggaaaaatcatcggcggcggacagccgttaggggtagttgccggaaaagctgagttcatgaatgcgatcgacgggggtacctggcagtatggggacgattcctatccgcaagatgaggcgaaacgcacgtttgtggccggcaccttcaatactcacccgcttaccatgagaatgtcgttagccgtgcttcgccatttacaaaccgagggagaacacctgtatgaacagctgaatcaaaaaacagcctccctggttgatcggctgaatcgcttctttgaacaatcgcaagtgcctatccgcatggttcaattcggttctttattccggtttgtctcatcgcttgataacgacttgttcttttaccatctcaattataaagggatctatgtgtgggaaggacgcaactgcttcctatccacggcgcataccgcggatgatattgaacacatcattcaagctgttaaagacacggtgaaggatcttcgccgaggcggatttattccggaaggcccggattcccctgatgacggcggacataacaaatcaggggcgtacgagctttcagatgaacaaaaacaattggttatggcatcccattacgggaatgaagcgtccgccgctttaaaccagtccattatgctgaaagtggagggcgaactgcagcatacaccattaaaacaagccgtccggcatatcgttggccgtcatgaagctttacgtacagtgattcatcccgatgacgaggtacagcaagtgcagaaacggatgaatatagaaataccagtcattgattttactgttcacccgcatgaacatcggcagtcggaaattcaaaaatggctgacagaagatgccaagcggccgttccatttccatgaacaaaagcctttgtttagaatccatgtgcttacatcggctcacaatgaacatctgattgtgctcacgttccatcatatcattgtcgatggatggtcaatcgccgtatttgttcaagaactggagagcaactacgcggcaatcgtacaaggaaaaccgatttcaccgaaagaggcagatgtttcgtttcgccaatacttagactggcagcaggcacagattgacagcggccattatgaagaaggggtccgttattggcggcgtcatttctctgaaccgattcagcagccaattctgccgagcacaggttctgtccgttatccgaacgggtatgagggagaccggtgtaccgtcaggcttggacggccattgagcgaggctttaaggtcattaagcattcagatgaaaaatagcgtatttgtgacaatgctgggtgcatttcatctttttctgcaccggcttaccaaacagtcaggccttgtgatcgggatccccgcagcaggtcaatcgcatataaaacagcatgatctgattggaaattgcgtcaatatgattccggtgaagaacacgtctacttcagaaagcactttaaccggttatcttggcagtatgaaagaaagcgtgaatcttgcaatgcggcaccaagccgtcccgataacactggtggccagagagcttccgcacgatcaagtgccggatatgcgtattatctttaatttagacaggccttttcgaaagctgcatttcggaaaggcggaagcggagcccgttgcatacccggtaaaatgcaccctgtacgatttatttcttaacataacagacgcgcatcaagaatatattcttgatttcgactttaatacgaacgtcatcagtccggaaatcatgaaaaagtggggagcgggttttacaaaattgctgcaaaaaatggttgagggagattcaatccctcttgacgccatgatgctgttttccgatgaagaacagcatgatttacaagcactttatgccgaacaccagaagcgggtctcttcaataggaagcaatacagcaaatttcactgaagcctacgaggcgccgataaatgaaacggagcggcagctggcgcggatttgggaggaacttttcggccttgaacgggtcggcagatcagatcgcttcctggctctgggaggaaactcgctccaggcgacgcttatgctttccaaagttcagaagacatttcatcaaaaggtttccatcggacaatttttcaatcaccagactgttaaggaattagcacatttcattcagaacgaaacaaaagtcgtgcacctcccgatgaaggctgccgagaaaaaagcgtattacccgacatcgccggcgcagcaaagagtatatttcctgcaccaactggaaccggatcagctggcgcaaaatatgttcggccaaatatcaataacagggaagtacgatgagcaagccctgatctcatctcttcaacaagtgatgcagcggcacgaagcgtttcgcacgtatttcgacattatagatggcgatatcgttcagaaacttgaaaacgaagttgattttaacgttcatgtccggacaatgagccgggacgaatttgatgcctattcagaccggtttgtaaaaccgttccgcctggaccaagctccgttagttcgtgcggagctgatcaagattgaaaacgagcaggccgaactgctcatcgatatgcatcatatcatttcggatggttattccgtcaacatccttacaaatgaattgctggctttatatcatcagaaaccattaccggacattgaatttgaatataaagatttcgcagaatggcaaaaccaacggctgaatgaggatgccatgaagcggcaggagacatattggctggaacaatttcaagacgaaattcccatccttaacctgccgacagacggttcaaaagcggcagaacggtcttctgagggacagcgagtgacatgctccttacagccggatgtcatccgttcgcttcaagatttggcgcaaaaggcggaaaccactctctatacagtgctcctggccgcctataatgtgctgcttcataaatataccggacaagaagacattgtcgtaggcacgcctgcttcaggaagaaatcatccggatatcgaaaagatcatcggtattttcatacaaaccatcggaatccggacgaagccgcacgccaatagaacgttcacggattatctggaagaagtaaagcggcagacgcttgacgctttcgaaaaccaagactatccatttgaccggcttgtggagaaattaaatgtgcagcgggaaacaaccggaaagtctctgtttaacacgatgtttgtgtttcaaaacattgaatttcatgaaatccggcacaatgaatgtacatttaaagtgaaagaacgaaatccaggggtctctttgtatgatttgatgctcacgatcgaagatgccggtcaacagatagagatgcattttgattataaaccgggacgattcacaaaagacaccattgaacagatcaccagacactataccggcatcttaaacagtcttgttgagcagccggagatgacattgtcttccgttcctatgctgtctgaaaccgaacggcatcaactgctgacggagtgtaacggcacaaagacgccgtatccgcataacgaaacagtaacccgatggtttgaaatgcaggcggaacagagtcccgatcaggaagccgttatttttggcaatgagcggtatacgtacagacagctcaatgaacgggcgaaccgattggcgcggacgttacggacaaaaggcgtacaagcggatcaattcgttgccatcatctgcccgcatcggatcgaactgattgtcggaattttggctgttctgaaagccggcggcgcatacgtgcccattgatcctgaatatccggaagatcggatccaatatatgctgagagattcaagggcggaggttgtgttgacacagcgcagcctgctggatcaattaccgtatgatggtgacgttgtgcttttggatgaggaaaactcataccatgaggatcactcgaatcttgaatcggacagcgatgcgcatgatttggcctacatgatctatacgtcaggttccacgggaaatccaaaaggtgtcctcattgagcatcagggactggctgattatatttggtgggcgaaagaggtttatgtaagaggtgagaaaaccaacttcccattatactcttccatctctttcgatctgactgtgacctcgatatttacaccgctggttacgggaaataccatcattgtctttgacggcgaagacaaaagcgctgtgctttctgagattatgcgggactcaagaatagacatgatcaaattgaccccggcacatctgcacgtcatcaagaagatgaatatcggtggcggcaccgcaatacggaaaatgattgtcggcggagaaaatttaagcacccgtctggccaaaagtgtcagcgagcagtttaaaggccggctggacatttttaatgaatacggaccgacggaagctgtcgtcggatgtatgatttatcacttcgacgcagaacgggacaagcgggaatttgtaccgatcggcactccggctgccaatacggatatttatgtggccgatgcaagcagaaatctggttccgatcggggtaatcggcgaaatatatatcagcggaccgggtgttgccagagggtattggaaccgtccggatttaacggcagagaaatttgttgaaaacccgtatgtcccgggagcgaagatgtacaaatcaggggatttggctaagcggttgaaggacggaaatcttgtatatatcgggcgcattgatgaacaagtcaaaatcaggggacaccgaatcgagcttggtgaaattgaagcagcaatgcataacgcggaagcggtgcaaaaagccgcggttacagtgaaagaagaagaagacggcttaaaacaattatgcgcgtattacgtaagcgacaagcctatagcggctgcgcagcttagggaacaattgtcatcggagcttccggactacatgattccgtcctattttgtccaactggagcatatgccgttaacgtccaacgggaaaataaaccgtaaggcactgccagcaccagaagcgagtctgcagctgacagctgaatatgttccgccgggtaatgagacggagtccaaactgacagatttatggaaggaagtgctcggaataagccatgcggggatcaaacataatttctttgatctcggaggcaactccatccgagcggctgccttagccgccagaattcacaaagagctggatgtgaatctgtctctaaaagacatattcaagtttcctaccattgaacaattggctgacaaggcgttacacatggacaaaaaccgatatgtaccgattccggctgcaaaggaaatgccatattatccggtttcttcagctcagaggcgtatgtatttgttaagtcacacagaaggcggcgagctgacttacaatatgacgggtgccatgaatgtggaagggacgatcgatcccgaacggttaaacgccgctttccgaaaattaatcgcgcgtcatgaagcgttgcggaccagctttgatttatatgaaggcgagccggcacagcgtattcatcagaacgtcgactttacgatagaacggattcaagcaagcgaagaagtagcggaagaccgtgtgcttgatttcatcaaagcgtttgacttagccaaaccgccgctgatgcgggccggactgattgaaattgaacctgcacggcacgtgcttgtggttgatatgcatcatatcatttctgacggcgtgtccgtcaatattctgatgaaagatttaagccgaatctacgaggggaacgaaccggacccgctctctattcaatataaagactttgcagtttggcagcaatcggacattcagaaacggaacatcaagagccaggaagcgtattggctggatcagtttcacagtgatattcctgtactggatatgcctgcggattatgagagacctgccatacgcgattacgaaggcgaatcatttgaatttcttatacccgaacacttgaaacagcgtttaagccaaatggaagaagacacaggagcaacactgtatatgattttattggcggcctatacgattcttttatccaagtacagcggacaagaagatattatcgtaggaacgccatctgccgggcggactcatttggatgtagagccggtcgtgggaatgttcgtcaatacgttagtcattcgcaatcacccggcgggccgtaaaacatttgatgcctacttaaacgaagtaaaagaaaacatgctgaacgcctataaaaatcaagactatccattggaagaattaattcagcatctgcatcttccaaaagattcaagccgcaatcctttattcgatacgatgtttgtgctgcaaaatctcgatcatgctgaattgactttcgattctcttcaactcaagccgtattcatttcatcatccggttgccaaattcgatttgaccttgtcgattcaggcggaccaagacaactatcacggactgtttgaatattcgaaaaaactgtttaagaaaagcagaatcgaggttttatcaaacgactacttacacattctatcggcgattttggaacagccaagcattctaattgaacatatcggattgagcggcagcaatgaggaagaagagaacgcgcttgattctattcaattgaacttttagggaaaagcattatttctttaaattatataaaatgaggtgctccaatgtcggtatttaaaaaccaagaaacgtactgggaaaacctgtttgatgaagaagacggattaagcgcattcccttactttaaagcagcggataaagcgtcgtttgcccgtaccggctaccaggaaaaatgcatctgccgttccttatctccggaagtatctcaaagaatcatgacaatggcgaatcattccgatatggcggcctatctgattttattggcgggtattgaatgcttgttatataaatatacggatcaaacgagcctgattcttggcattccgacggtatcgaagcaaaaagccggccagtcagccgttaacaacattgtcctcttaaaaaatacgctttcaaacgagagtacatttaaaaccgtattcgggcagctgaaagaagccgttaatgattctctgaaaaatcaaaacctgccgtttagaaaaatggttcagcatctgagcgtgcaatacaatgacgagcatctgccgttgattcataccgtcgtttcgcttaacgaaattcattccttgcaatttaaagaagatactgcagccgatacgctgtttcactttgatttggagaacaacgggattcatttgaagcttttttataacggcaatctgtacgatgagcgctatatcaatcaaattgtgtcccatttggatcagctgctgtctgtgattctgtttcagcctcaagccgcgatccatacggcagagatcttaccggaagcggaaaaacagaagctattgtttgattttaacgacaccgtcagagatttctccgggagcagaacagtctatcaattatttgaagagcaagcagaaagaacgcctgagcatgcggccgtcaagtttaaaaacgaccatttgacgtacagggaactgaatgagaaggcgaaccgtttggcaagaacattgcgtaattgcggggttcaacccgatacgttagtcgccattctcgctgatcgttcattagagatgatcgtatccattatagccgtttggaaggcagggggcgcttatgtgcccctggatcctgaatatccaaaagagcggcttcaatatttgcttcatgatgcggatgcagacgttctccttgttcagcgtcatttaaaaaacagtctcacctttgacggcccggtgattgatttgaatgatgaaacatcataccatgccgatagctcattgttatcaccagcaacgggacacagccatttagcctatgtcatttatacgtcgggtacaacaggaaagccgaaaggagtcatggttgaacacggcggcattgtgaattcgctccaatggaagaaggcgttttttaagcattctccggcggatcgcgtgcttgtcttgtacccgtatgtttttgatgcgttcattttaaatttcttcggcccgctcatctcgggggcaactttgcacctattgcctaatgaagagaataaagaaactttcgccattcaaaatgccataaaacaagagagaattactcatttctcaacttctccccgtcttctgaaaacgatgatcgaacagatgaacacagaggacttcatccatgttcagcatgttgttgtaggcggtgagcagctggaaacagatacagttgagaagctgcattctctgcagcctcgcattcggatcaataatgaatacggaccgacagaaaacagcgtggtatctacatttcaccctgttcagtccgctgatgaacagatcacaatcggcagcccggtggccaaccatcaagcttatattttaggagcgcaccatcaaatccagccgatcggcgtaccgggagagctgtatgtcggaggagcgggagtggcccgcggctacctcaatcgtcctgaattgacggaggaaaaatttgtggagcatctgcatgtccctggtcaaaagatgtataaaacgggtgatctcgccagatggctgccggatggaagaatcgaatatttagggcggattgatcatcaagtgaaaattcgcggctaccggattgagatcggcgaggtagaggcagccatgttcaatctggaaaacgttcgtgaagccgcagtcgtcgcgcgggaagacgcagacggggccaaacaattgtatgcctattatgtcggcgggccttctttgaccgctgcgcagttcagaaaagaattatcccgggaactgccgaattatatgattccctcccgctttatcccattggaacgcattccgctcacttccaatgggaagattgatctgaaagctttgcctgctgctgacgaaaatacgcgggcggaatacgaatacatagccccgcggaacacaatagaagaactgctggcgtctatctggcaagaagtattaggggcagaacgtataggaattctggataatttctttgattttggcggagattcgattaagtcaattcaggtgtcatccagattgtatcaagccggatacaaggttgatatgaagcatttgtttaaacacccctcgattgctgaacttagtcagtttgtagcgccggtcagcagggtggctgatcaaggagaagtgaatggcggaaccaagctgaccccgattcagcattggttttttgaacaaaacatgccgcatgcacaccattacaatcaggccgtcatgttatattcggcggaaagctttaaagaggctccgcttcgccggacgatggaacagatcgcgtcgcatcacgatgccttgaggatgatttttgaaaaaacgccggatggatacgctccgcgaattacaggaacagatgaaagtgaactataccatctggaagtgatgaattataaaggggaaaccgatccggctcaagcgattgccgataaagcgaatgagattcaaagcagcatggtattagacaaagggccattgatgaagctcggtttgttccaatgtccggacggagatcatttgctgattgcaattcatcatttgctgattgacggagtatcctggcgtattttgctcgaagattttgcaagcggttatgagcaggcagaacgcggacaaacgatccagctcccgcaaaaaacagattcgtttccattctgggccgatcaattgtccaaatatgcggcggaaaccgacatgaaagaggagattgcttattggactgagctttcaagcataaagcctcagccattgcctaaggacactatcagcgaaggatcgttattaagtgacagcgaagaagtgacgattcaatggacaaaagaggaaacggagcaattattaaaacaagcgaaccgcgcctacaacacggatatcaacgatctgctgctgacttcgttagggctggctgttcacaagtggacaggcacggaagacattgtcgtgaatttggaaggccacgggagagaaccgattattccggatgctgacatttcccgcacgataggatggttcacaagccagtaccctgtcgtcctgaggatggaagccggaaaagacctgtcgcagcggatcaagatcgtaaaagaagggctgcgccgcatccctgataaaggaatgaattacagcatcatcaaatatatatccgggcatccggaagccgacagcatgcagctgaatccggagatatcgtttaactatttgggacaatttgaccaagacctgaagcatcaggctttgcgcatatcgccatattccacagggttatcgatgaacgaaaaccaagagagaacggccgtgcttgatttgaacggcatgattgccgaagggacattatcactgacactgagctacagcagcaaacaatacgaaagatctactatggcgcaatttgcccaagggttgaaagaaagtctgcaagaagtcattgcgcattgcgtaagccggcagcagacttctctcacaccaagtgacatcctgttaaaagatatctcaatcgacgaactggaacagcttttggagcagacgcgtgaattaggcgaagcggaaaatatttatccattaacgccgatgcagaagggcatgctgtttcacagcttatttgatccgaattcaggtgcttattttcagcaaacgatgtttgatctgcatggagatctggagattgattcattttcaaaaagcttggacggcttatcgcaaaaatatgatattttccgcacgaatttttacagaggctggaaggatcagccgctccaaattatattcaaaacgaaaaaaatcggttttcaattcaatgacatacgagagatgaaggaatcacaaaaagaagcgatgattcagcagtatgccagagaagataagatgcgggggttcgacttagaaaaaggcgcgttaatgcggctattcatccttcgtacggatgaaaagacataccgttttatctggagcttccaccatattttgatggacggctggtgcctgccgctgattacaaaagaaatattcgagaattactttgccttgcttcagcaaaagcagcctgaacaatcatcaattactccgtacagtcaatatattgaatggctcggccggcaagatgcgaaaaaggccacggcttattgggatcaatacttggagggatatgaggagcaaaccggccttcctaaggatcaccatgcagcggaagacggacgatacgttcctgaaaaagtgacgtgtgacataagctccgatctcacttcgaaaatgaagcggacggcaggccagcatcatgtcacgctgaacacgctgctgcagacggcatgggcggttttgctgcagaaatataaccgcagccgggacgttgtgtttggaagtgttgtatccggaagacctgctggaattccaaacgtggaaaccatgatcggcttattcattaacaccattcccgtccggttccggtgtgaagccggaacaacgtttgccgagcttatgaaagaggcgcaagaaagggctgtagcgtctcaacaatttgagacgcacccgctgtacgatattcaagcgcgcacaacgcaaaaacaagatttaattacacatttaatgatattcgaaaattatccggttgatcagtatatggaaagtataggccgccagaacggaacatccatcacgatctccaacgtgcaaatggaagaacagaccaactacgattttaatttgaccgttataccgggcgacgagatgaccatctcttttgaatacaatgcaaatgtgtatgatcgggcaagcatagagcgggttcgggaacatttcatgcaaatcctgcaacaagtcgtgacaaatgcggatatccgggtggatcaagcggaattgttaacggaaggcgaaagaagaacccttctgcagacgcttaacgacacggccgcgccgtttccgcagacgccggttcatcaattatttgaagagcaatcgcagcgtacgcccgatcaagcagccgtcattgataaggacaggcagctcacgtacggagagctcaataagcgggccaaccgactcgcgcgaacgttaagagcgaaaggagtccagacggatcagcctgtagccatcatcacgagaaacagcatcgaatcggtggtcggaatccttgccgttttaaaatcagggggagcctatgtccctatagatccggaatatccgcaagaccgcatacggtatatgctggatgactcccaagccggaatcgttttaatgcagcgggacgtcaggaaacagcttgcctatgaaggcgtcacggttttacttgatgatgaaagttcttatcaccaagatggctctgaccttgctcagataaatgatgtgagccatttggcatatgtcatttatacgtcaggttccacaggccggccgaaaggcgtactaatcgagcaccaaggcttgaccaattatatttggtgggcgaaagaggtttatgtaaaaggcgagaaagccaacttcccattgtattcgtcaatttcttttgatctgacggtgacttctattttcacgccgcttgtcacaggaaatgcaatcatcgtctatgacggagaagataaaacagctctgcttgaatcgattgtgcgagacccgagggtggatatcattaaattgactccggcccatttgcaggttttgaaagaaatgaacattgccgatcaaacggctgtccgaagaatgattgtgggcggggaaaacttaagcacccggttagcccgcagcattcatgaacagttcgaaggccgggttgaaatatgcaatgagtacggaccgacggaaaccgttgtcggctgcatgatttaccgttatgatgccgtaaaggacagacgggaatcggtaccgatcggaaccgctgcggcaaacacgagcatttacgttcttgatgagaatatgaaacccgcgccgatcggagtgccgggagaaatctatatcagcggcgccggtgtggcaagaggatatttgaaccgtcccgaattaacggcagagaaatttgtcgatgacccgtttgaacccggagcgaagatgtataagaccggagatttggcgaagtggctggcggacggaaacattgaatatgcgggcagaatagatgaacaagtgaaaatcagaggttatcgtatcgaattaggcgagatcgaggcggcactgcttcaagaagaagcgatcaaggaagctgtcgttacagccagagaggatgtccacgggtttaaacaattgtgtgcatattacgtaagcggcgggcaaacaacggctgcccggctccggaaacaattgtctcatacccttgcaagttatatggttccggcttattttatcgagcttgatgaaatgcctttaacttctaacggaaaaataaacaaaaaagggctgccggctccggatttcgagctgcaggacagagcagagtataaagctccccgaacaaaagcggaagaaatattagtttctgcctgggaatcggtattaggcgctgaaaacgtcagtattcttgataatttctttgaccttggcggagattccattaaatccattcaagtatcctccagattaaatcagcaaggatacaaaatggaaatcaaagacttgtttcaatatgcaacaattgcagaattgagtccgcatatcaagcagaatctgcgtatagccgatcaaggtgaggtcaaaggaaaagtcagcctgactcctattcagcattggtttttcgaacaaataacgacagatcagcattattataatcaagccgtcatgctgcatgcgccggaaggttttcaggaaacgcagcttcgtcaaaccctgcaaaaacttgctgaacatcacgatgcgctccgcatgacgttccggactacggaaaatggctgcgaggcacagaatgaagaaatcgcccaaagcggactgtaccgcttagaagtcctgaatctgaaagaagattccgatccgggacggacaattgaagccaaagctgatgagatacaaagcagtatgcgtttaagtgatgggccgttaatgaaagccgggttgtttcaatgcgcaaatggagatcatctgctcatcgccatccatcatttgattatagacgggatttcatggcgcattttactggaagatatcgttagcggctacaagcaagccgagaatgggcgagtgattcaactgccgcaaaaaacagactctttccaattatgggctaagagactttcagaatatgcgaaaagtgaaaccataaaacaggaacaggaatattggacaaagatcgaacaaaccgaagtcaaaccgctgcctaaagattttcatgaaacccatacaactgcaaaagacagtgaaacagcaactgtggaatggacgaaagaggaaacggagctgctattaaaacaagcgaatcgcgcttataacacggagataaacgatttgcttttaacttctctcggtctttccatatcgcattggtcaggactgaaacaaattccgattcatttagagggacacggccgagaacagattatacaagatatagatatctcccgcacggtcggatggtttacaagtctgtatccggttgtgctgcacgcgcagccgggcaaagagatctctgattatatcaagacgaccaaagaaggattgcgccaaattccgcataaagggatcggatatggaatagcaaggtacttaagcggcggaatgccatcgaaactcaatcctgagatcagctttaactacctgggacagtttgaccaagatttacagcagcatggggttcaattatcttcttattcttgcggttcagactctagcggaaatcaagaaagaccgtatgtattgaatataaacggaatgatcaccgacggccggctgaagcttacgatcagctacagcagcaaacagtacgcaaaagaaacgatcatgcggttatcggaaacgattcaaagccgcctgcggacaatcattacgcattgcgtccatagagaacaatcggaactgacgccaagcgatattttgttaaaaggcatgtccattgacgaattggatcagctcctcattcaactgccgcatgcaggtgaggttgaaaacgtgtatccgctcactccgatgcagaaaggaatgctcttccacagcctgctggacgaggcctcaagttcttattttgaacaagcatcgttcgatttgcagggagaattaaagattgattggtttaaagcaagccttgaacgattatttgaaacatacgccgtgctcagaacccgtttttacagcggctggaacgatactcctttacaaattgtctataaaacgcaaacaccgcaaattcattttgcagatttgcgtgatatagaggagcacctgagagaggatgcaatcgcagcctatcaaagagaagataaggcaaaaggatttgacttggctcgggatccgctgatgcgcatagcgattttccgtatggaagaccgcaaatatcatttgatttggagcttccatcatattgtgatggatggctggtgcctgtctcttatcacgaaggaagtgtttgatcattatcgcgccttacaagaaggcagggaaccagaaccgtcatcggcagctccttacagcaactatatcgagtggcttgaccgccaagatcagggagcggcaaagcggtactggagcgggtatctcgaaggatataaaggtgaaaccacgcttcttcataaaatagagcagcatgaacaaaaagaatacgcctatgccaatgtgacctgccgatttgatcacgaacagacaaaacaattacagcagatcgcaaatcagcatcaggttacattaaatacgttgatccaaacgttatggggagttttattacagaaatacagcgggtccgcagacgttgtcttcggcagtgtcgtgtcgggaagaccggcggaaattcctgatgtggaacagatgatcggcctgttcatcaataccattccggttcgcatccgctgcgatgaggacagcacttttgctgatacggtgcaaatggttcaacaaaacgctctggcttcccaatcatacgatacctatcctttatacgaaattcaggcccaaacggaacaaaagcagaacctgattgaccatatcatgatttttgaaaactatccgatcggtcagcaggtcgaagagacgggacatcatagtacggagctgaacattacgaattttcatatgctggaacactcccactatgatttgaatgtagttgtcatacctggcaaacagctggccgttcatttcggttttaatgaaaacgaatatgaaaaatcagaagtggagcggatctgcggacattttgaacagctcatgcagcaagtattacagcagccgtctgtcaaaatagaagaattggagcttctctctaggcaagaaaaagaacatttgctcagccgctttcagtctaatgacatgcattacccgcttgaacaaacgatacatgagctgtttgaggaacaggcgcatcgtactccggacaatacagcggttgtattcgagggtaaacaactcacctacggagaactgaaccggcgtgccaatcagcttgcgcgaaccttgcaggcaaaaggtgtgcggaacgataagcttgtcggtattatgactgaacgctcgcttgagatgattgtaggcatcttgggagttttaaaagcgggcggcgcatatttgccgatagatcctgattctccgtctgaacgcatcagttatattttaaatgattcaagcatcagcgtattgctttaccgcgggaagctgcaggatgacatcggcttctcaggaacatgtatcgatctcatggaggaacatttctatcaccaaaaagacagcagtcttgcactctcttatcagtccagtcaactggcctatgccatttatacttccggtacgacaggcaatcctaaaggcacgttaattgaacatcgccaggtcattcacctgattgaaggacttcgacgccaaatttactctgcctacgatgcggagctgaatgtagccatgctcgctccatattatttcgatgcttctgttcagcaaatgtatgcttccttgctgtcaggacataccttgtttattgttccgaaagagattgtgtcagacggtgctgccttatgccgttattatcggcagcattcgattgacatcaccgacggaacacctgcccacttaaagcttttgatagctgcaggtgatttgcagggagttccgcttcagcatcttttaatcggaggagaggcactttccaaaacgacggtaaataagctcatgcaattattcggcgatcatggcgcttcacctgggattaccaatgtatatgggcctacggagacttgcgtagacgcgtctctgttcaacattgaatgttcttccaatgcgtgggcacgcagccaaaactatgtccctataggcaagccgttaggcagaaaccgcatgtacattcttgattcaaaaaaacggctgcagccggcgggcgtccaaggcgagctgtatattgcaggggacggcgtcgggcggggttacttgaacctgccggaactgacggacgaaaaatttgttgccgatccgtttgtaccggaggaccgaatgtacagaaccggtgatctggcccgccttctgccggatggaaatattgaatatatcggccggattgatcatcaggtgaaaattcaaggttttcggattgaactcggtgaaatcgaatcggtgatgctgaacgttcctgatattcaagaagccgccgcagctgcccttaaagatgcagatgatgaatattacttgtgcggatactttgctgcggataagacaatacagatcagtgaacttcgcgaaagaatggcccggcatttaccgggatatatgatcccggctcaatttgtgcagctggataagatgccgctgacgccaaacgggaagttgaatcgccagttattgccggctccggtcaaaaagcgtgacggcggcatagagtacgtcccgccgcaaacttcggaagaaatccagctgacagcaatttgggaagatgtcctcgggttagagcaggtggggatcagagatcacttttttgagatcggcggacactccctgcgggcaacggcgctgattgcaaaaatacaaaagcaattgcatgtccaaattcctttgcgggacgtcttccgtctcccaaccattgaacagctcgcacagacgatcacgaagacggagctgaccggatatgctgcgattcctgcaattgaaaaaagaccttattatccggtatcctcagcacaaaaacggttgtacatcctgaatcacttggaaggcggagaactcagttacaacatgctgggactgatggctgtcgaaggcaagcttgaccgtgacaagctgcagcaagccttccgcacgctgattttgcgccatgaatctttgcgcaccggttttaaaatggctgacggagaacccgttcagtatgtcttagatcacgcaaagttcgaagcagagtggtatcaggcagaagaaaatgatgcggacctttatatccgcaaatttattcgtccatttcatctggatgagccgccgctgcttcgcgtggggctgattgaacttcaacctgaccgcggaattctgatgtttgatatgcaccatattatttctgacggaacatccatgagtgtattgattaaagaatttatccgcatttatgaaggagaaacattaccgcctttgcgcatccagtataaggactacgcagtatggcagaccggcgaagcgcggttaaaacagatccaaaatcaagaagcctattggttagagctgtacagcggcgacgttcctgtccttcatctgccgaccgattatatccggccgtcggcacgggattttgcgggagccacaatgcagtttacgcttgataagcaaaaaagcgccgggttaaagcagctggcatcccaaactgaatcgactttatatatggtgctccttgcgtcttatacattattgctttcaaaatacagcggccaggaagacataattgtcggcagtcctatagcgggaagaccgcacgccgatttggaaccgattatcggaatgtttgtgaatacattggccatgagaaattaccctgaaaaagggaagacgttctctcagtatctgtccgaggtgaaggagaatgcattaaaagcttatgagcatcaagattatccgttcgaagcgctgatcgatcaactgaatatcgcaagagacttaagccgtaatccattgtttgacaccatgtttgtgcttcaaaacacggagcaggaacagttagagataaatgacgtcactttcaaaccatatccaagcgaacatacgatggctaaatttgatttaaccttaacggctgtggaagaagagtcgggtattcagttcacaatggaatacttgacggctctgtttaaaccggaaacgatcgaacgcatgatggggcattttgtgcagctgattgattcgattattaaacagcctgatgccgagctggctcgtctgaatatgatgaccaaggaagaggaaggagacattcagcaactctttaacgatactgcagttgcggaaaaacgaattccgacaacgattcatcagctttttgagcagcaggctgagcttaacccggatcatgaagccgtcatgtttggaattcagacactgacttatcgtcagctgaatgagcgttccaatcagctggcgcgcatccttcaagataagggggcctgcactgatcaggttgttgccgttctcacggatcgctcagcacatatgatcatcggcattttagccatattaaaggccggcgcagcatttcttcctattgatccggagcttcccgaaaaacggcgggcttttatgctgaaagacagcggcgccggtgtgcttttgacttgtgcaggccacgctattccgccgcgctttgaaggagaagtgcttcagcttgatgatccgatgatatatcaaggcagagcagacaatcttaatctttcctgctcggaaaatgatttaatgtatgttatttacacgtcaggcacaacggggcagccgaaaggagttcagctggagcacaagacgatgacgaatctgctcgcttatgagcaggatcatacgcagcttcgctttgacagagtgctgcaatttgccgcgatgagctttgatgtctgctatcaagaaatgttctccgcgctttcaagcggaggaacactctttatcatcggcaatgaggcaaaacgtgacatacgtcagctcaatgattttgtcagaacgcacgggatacaaacagcattcctcccgacagcgttccttaagctccttgcctcagagaaacaatatttcgaaccgtttgccgcgtgcgtggatcacatcatcgctgcgggagaacagctcatcgtaacaagtatgctgcgtgacatgctggcacgccatcaagtcacattgcataatcattatggcccgtcggagacgcatgttgtgaccatgtataccgtcgatcctgatacagatcaggagcttcagccgatcggcaaaccgatttcaaatacggagattttcattttgaatgaagccggaacgcttcagcctgtcggaatcgtcggtgaactttgtatttcaggagcgagccttgccagaggctatcataacagggagcctttgacactcgaaacttttgttccgcacccatatgactcgaatcagcggatgtataaaacaggcgatctggcccgttaccttcctgacggaaacattgaatatgcgggaaggagagaccaccaggtcaaaatccgcggttaccggattgaactcggtgaggtggaggccgctcttctcaagcacgtacaggaagcagttgtcctatcaaaagaaaataccgatggccaaatcgatttatatgcctattttacagcggagcaatcactctcgatcagtcagctgaaagaaaaacttgctggccaaataccgggatacatgatcccttcatacttcatccagcttgagaaactgccgctaaccggcaatggaaaagtaaatcgaagagcattaccgatgcctgaagcaggtttacaaacgggaaccgactacgttgctccgcggacgaatatggaagagcagctgatatgcatctggcaagacgttttgaaggtaaaagaaataggtgtaaaagataactttttcgatttgggcggccactcgttgcgggggatgacgctcatcgccaaaattcataagcaattcagcaaaaacatttcattaagagaggtctttcaatgtccgacagttgaggaaatggcaaaggcaattgcaggagctgaaaccaacgggccggattacattccgaaagccaaagcaaaagatgtctatcctgtatcttccgtgcagaagatggtttacctgtcaacacaaatagaaggcggagaactgagctacaatatgccgggaatccttacattagaaggaaaactcgacataaatcgcttgcaaaccgctttccaaagactgatccagcgtcatgaatcactgcgtaccggttttgagctggtccgcggagaaccggtgcaggtgatcaaaccgcaagcggagttttcgatggaaagatacaaggcaacagctgacgaggttgaggaatgtttccgcaccttcgtgcggccgttcgatctcagccaggctccattactcagggccggactcatcgagttagaacaagacctgcatattttcatgtttgacatgcaccacatcatcacggacggcgcctccatgaatatttttgtcgaagaactgattcaattgtatgacggcaaagagttagctccgctccgtattcagtacaaagactttacggaatggaaacatcaaaaagagcaaagagaacgaatcaagaagcaggaagggtattggcttggtgtatttcatgaagagctgccttcatttgagctgccgaaagattttgcgagaccgccggttagaagctttgatgggaaaaggcacaattttacgctcgataagactgtcacccaagggataaagcagctggaagaattgaccgggacgacagcttacatgattttgttctcggcctattccatactgctggctaaatacagcggtcagggtgatatcgtcgtcggcacacctattgcggggagaccgcatgcggatttggaacccattatcggaatgtttgtcaatacattagccatccgcaccgctccgatggcggaaaagacatttttggattatataacggaaacgaaagaaaccatgctgaaggcttttgaacatcaagagtatccttttgaagaattagttgaaaaactgggtgtaaaacgggacttaagccgcaatccattgtttgatacgatgtttgtcctgcaaaatacggaacaaacggatattgaagtggactctctcgcagtcaggccttatgaacaaacagagacggcagccaagtttgatttacagctgaacttcttaatagatcaagatgagattcagggcagttttgattactgtacaaaactgtttaaaaagaaaaccattgctgtattggccaaggattacgtcatgatcctttcggcgattatgagaaacccatccattcctttaaaagacattcaattaagcgaaaaagtaaacaaaagtaaacatctcgcaagcacaatcgaattggatttctaatcacgggggcagcggctgtcccggcatgaatgccgcggctgccgccagctgcctgaaaacaggaatgaaaccaactggagggatatgaatgtcagaattcaaacaacaggagttgttctggggccgaatgtttcacacggaagaccgtcccggtgcattcccttcgtttcaagtgtccgactcaacagtaaagcgtgatataacaagcggatctgactgtattcacagttcattgagtgcggaggtatcacggcgcatcctgaccatgacgaaccaaacgccaatggccgtctatctggttctcctggtcggaattgaatcccttttatacaaatacacgggggatgagggagtgattacaggggttccagcctttgaagacgaaactgatgaagatcttcgttcagaccagctcatgttaatcaaacagcagatcaattccggcagtacgtttaaatcaattttccatgaattgaaacatacgctggacgaagcgatcttatatcaggacgttccctttgataaaatggccggacagctgaggctgaactacaatgcaaatcatttgccgatcatccatacagttgtttcactagagcaaattcattctgatggtttcatagaaacggctgctgcagatgctttatttcagtttgctatgggtgaagacttgattgacctaaaattatgttttaatgaacaagtctatgaccgtcagtatatgatgcaggtgctcggacatttaaaccggctattttctgtcatattatttcagcctgacctccccctcggccaagtggatattttgccagaatcggagacacatacacttctcgttgacattcaaactgcgaaaactgaatatccgcgggataagacggtttatcagttattcgaagaacagatgaaacgaacaccggatcaagcagccgttatttacggagaaaagcaattcacatatcgtcagctcaatgaacgtgccaatcaattagcccgaacgttaaggaaaaagggggtaaagacggaccggctcactgcgattatttgcgagcatgagatcgaactggtcgtgggaatattggccgttttaaaagcgggaggggcctatgtgccaattgatccggattatccgaagcatcgcatacagtatatagcagaagactcccaagctgatatcatcctgacgcagagccatcttcaaaaacagttggaacttgcgggcacaatggttttcctcgatcaggaaagctcttaccacgaagacggctctgacctggaaccgatcagcagtacgaaggatttggcttatgtcatttatacgtcaggctccacaggcaagcctaaaggagtggcaattgagcatcagggcttaaccaattatatttggtgggcccgccgggtctatgtcaaaggggaaaaaaccaactttcccctatattcgtccatcgcttttgatctgacgataacgtctgttttcactccgctaattacaggaaattccattattgtctacggaggagaaaacagtgctgccttgcttgattgcattattcaggattcaaggacggatattatcaagctgaccccggcgcacttgcagttattgaaagagatgaatatccctgctgagtgcaccattcggaaattcattgtcggcggtgacaatttaagcacgcggctcgcccgtagcatcagcggaaaattcggcggaaaaatcgaaatttttaacgaatacgggcctacagagacagtcgtcggctgtatgatttattcctttgatccgcaaaacgacagacgggaatcagtgccgatcggaaccgccgcggacaacatgaacattttcgtgctggataagagcatgaagccggtgccggccggcgttccgggagaaatctatatcagcggggacggcatcgccagaggatacttgaacagagcggaattaacagcagaaagatttttgcagcacccctttgtgccagaggtgaaaatgtaccggacgggagatttagcaaggcggctcccggatggaaatattgaatatttaggccggatcgaccaccaggtgaaaatccgcggttaccgcattgaaatcggggaagtcgaatccgcatttttccaaataccgccgattcaagaagctctcgttacggcacaagaaaccaacggggaaacatccttgtgcgcctattataccgcacagcattctttaaccgcaggcgaaattcgggagcgcctgtcccggcaacttccgtcctatatgatccctgcttattttgtacagctggcagcgatgccgcttacttccaacggaaaaatagatcgtcaggctctgcctgctccaacgggaaatctcactggaaatccttatacagctccgcggacagaactggaaaaaatactggccggggtgtgggaatcggtattaggcgcagaacaggtcggaatcgatgatcatttctttgagctgggaggagattcgattaagtcgattcaggtgacctcaagcttatatcaagccgggtataagcttgacatcaaacacttgttcaaacacccgacgatctccgggcttgctccttttattgagcccattacccgaatcgcagaacaaggggagatcaaaggccgtaccttattgacgccgattcagcattggtttttcgcccggcaataccctgatccgcatcattataatcaatctgtcatgctttattttaaagggggtttggacgaatcgaagcttcagaaagtcatgaagaagattgccgagcatcacgatgctttgcgcatggtctatgttcagggagatcatgaatacgaagccagaacccgcgggatcagtgaaggagaattattcagcctcgacgtgttctctttactcgaagaaaacaaccctgccgaaacgatagaaacgatagcaaatgacattcagcaatccatccatttagccgatggaccgctcatgaaactgggattgtttcaatgtcaggatggcgatcatttgctgattgcgattcatcatctggttgtagatggcgtatcgtggaggattttacttgaggatataacgtcagcttatgagcagctccaaaacggagaagcgctcacgctccctaagaagacggattcctatctgttatgggctgaacgattgaaacgttatgcagaaagtccggaatttgaagcagaaaatcaatattggcttgagcagaaacatatctcgcaacacaaattgccaaaggataatgagcaggagaccggtctggccgaagaccgggaaacgatcatcgtccaatggacagaggaagaaaccgagcatttattaaaaaaatcgaacagggcctatacgactgacattaatgatttattgctgaccggactcggaatggctgttcatcgctggacggggcatgaagaaattcatgttcatctggaaggacacggcagggaatctatttttcaagacgttgatatttcacgtacagtgggctggttcacaacccaatacccggtttctcttcaaatccaggcagaccgggacatctcccagcggattaggacggtgaaagaacagctgcgtcagattccccaaaaaggaataggatatggcctgatgaaatattcgtccgatcatccgaaggcatcagaatggaccggacatccggaaatcagcttcaattacctcggacaatttgatcaagatctcgaaaatggaggaatcgaagtatctccttactccggagggaaaattgcaagcgacagacatcccattgcctatacgcttgacattaacggcatgatctcagacggccggctgtcattggccatcagttacagcggtaaacaatatcgaagagaaacgatggaaacatgtgcagctctcttaaagaacagcctaaaagaagtcatcgaacattgcgcagctcaagaagacattcacctgacgccaagcgatatctcactgaaggacataacaatcgaggaattagatcaatttgttcagcaaacacaacatatcggcgagattgaaaatatatatccattaactcccatgcagaaaggtatgctgttccatagtttaatcgattcggcttccagagcttactttgaacaagccgtttttgatctcaaaggcggcttggatatcgaggcatttacaatgagtttgtcgcagctggcggaaagacatgagattctccggactcatttttatacggaatggaaagatcagcctttgcagatcgtattccgaaaaaaaccgatcgaaataactgttgaagatattcgaagcatgaagaataaacaacgaaacgagttcattgccggctttgtacaaaaagataaggcaagaggattcgaccttatccaagatgcattaatgcgcgtatcaatccttcgtacagaggatgaccaagtccgattgatatggagcttccatcatattttaatggatggctggtgtctgcctcttattacgaatgaagtatttgaaacctattatgcgattcttgatagaagaaaagcggagcgggaagtcgtcaccccgtacagccgatatatcgaatggctggaagaccaggatcataagcacgcttcagcctattggcaaaaatatttggacggttatgaaggacaaactgttttactgaaagaacctgtctcaaaccaagccaagggatatcaaaaacaaaggcttgcatgccggctcggaaaacagctgtcagaagaaatcagacagactgcaagcaagcatcacgtcaccgtgaatacgttcattcaaagtgcgtggggactattgctgcaaaggtacaacaacagtcaggatgtcgttttcgggtcggttgtatccggccgcccggcagaaattccgggtatcgagtccatggtcggcttatttatcaacaccattcccgtccgtattaccgctcagcctggaatgactgtggaacaagtgttgaaaatgagccaggagcaggcattggcttctcaagggtatgatacatttccgttatatgaaattcaggctcaaactgaacaaaagcagcagctgatcagtcatatcatggtatttgaaaattatccggtcgagaaacaaatggagcatatgaaaccgaatcgtgacgcactggacattatcaatttccatatggaagagcatacccattacgatttcaatttcattgtcatgcccgcgggagaaatcgacattcattttgtatacaatagcaacgtctatgatcatgcaagtgtcaagcggatggaagagcattttatgcaaatcattaagcagatggtgaacagtcaggcgattcgcgtccaagacttggatatacttacgggggatgaacgttcgctccttatagaggcatttaatgatacggaagcagattatccaaaggaaaagacgcttcataaattgtttgaggaacaagcacagcgtacgcctgatcaaacggctgtcgtatacggggaaagccagctgacataccgggaactgaatgaaagagccaatcaacttgcccggacattgcaatcagaaggcgtgcagccggatcagccggtcgggattatggccgaacgttccttggaaatgatcgtaggactcttcggaatcttaaaagccggcggcgcgtatgtgccgatcgatccgagctatccggaagaacggattcactatatattggaggattcggatacgaagctgttgttagtacagagtcacttgaggaaaagcgtgccttttacgggaaaagtgcttgacctggaagatccgcgattctcttgggaagatggttcaaacttgaaacagactgccggaccgaatcacttagcttatgttatctatacttcgggatcaacaggccgaccgaaaggggttatggtggaacaccgatccgtaatcaaccgtctcgtttggatgcagaaacattacccgctggataagcaggatgtcattctgcaaaaaaccccaatcacctttgatgtatcggtgtgggaattgttctggtggtcgatgactggttctaaagcggtattgcttccaaacggaggagaaaagaaccctgacgtcatcttagatacgattgcgcagaaaaatgtcaccattatgcattttgtgcctgcgatgctgcatgcttttcttgagtccatggagcaaaaatccgacgaggaattaaagagaaagctggcatcattaaaatatgtatttgcaagcggcgaggctttgacgcctgcgcacgttgcggggtttcatcgcttgatcacaccggcgggtgaggctcaaatcatcaatttatacgggccgaccgaagcgacgatcgatgtatcgtattttgaatgcgaagcgggagaaacgcttaactcagttccgataggtaaaccgatttccaacattcaattgtatatcgtacaccccgaatcggaatattttcaaccgctcggtgtggcaggagagctgtgtatcgccggagacgggctcgcacggggctatttgaaccgcccggagctgacggctgagaagtttgcagctcacccatatgaagcagggaagctgatgtaccgtacaggcgacttggcaagatggctgcctgacggcaatatcgagtatttgggaagaattgatcatcaagtgaaaatccgaggctaccggatagaactcggcgagatcgaagcatctttactacaactcgatgctgtcaaagaagcggtcgtcatcgcgattgaaaaagagggctcaaaacagctgtgcgcttacttgtcaggagacgagtcattaaatacggcgcagctgaagcgtcatttgctgaacaatctgcctacgtatatgattccggcttattttgtacaagtagagaatatgccgataaccgctaatggaaaaatcgatcgaaaagcgttgccggctcctgagggaaataggcttaccggaaccgaatacgcagcgccaggaacgttaattgaaaagcagctggccgatatatggaaggatattttagctctgcctgaccccgggattaaagatcacttctttgacgttggcggccattcacttaaagtattgcagctcattcatcaaattaacgccagtatgggaatcaacatgcattatcaagccgtatacgattttcctaccatcgaaacaatggcacgcgccattcaagcggccgttttcgaatccgagacggataacgtattcgtcaagctgaatcaggaagattcaatccctgtgttctgtttcccgcctttaatcgggtatggactcgtttataatgaaatggcgaaaagacttgacggcgtcagcaccatctatgccgctgatttcttagaagagccgtctcatgggaaagagatcgttgaccggtatgcagaaagcatgataagcattcaagaacaagggccttttgttctgcttggttactcttccggatcgaatttggcttttgaggttgccaaagccttagaaaagcgggggcgcaccgtatctgatgtgattatgctggattctaaaatcaccgattcggtaactcatttatcggaagaggaaatccaagagatcgtccatctgaatatggacattattccggactactacagagaaatattaaccattccttcgattaaggataaaatcagaggctatcttgcgtatcacaatgaactgatcaattccggcgccgttaacgccaacatccatcatttgctatgcggcgatgtaaccgatgataggggctggacacaatcaacagcacagcattatcttgagtacaaattaaaaggagatcacgtgacgatctttgaacctcacaatatcgaagaaaatacggatgcaattcgatctattattaaacggattgaagaacggcatcatcacggacttgttcttgaagaacaactgtcaataggatcgtttgctggcgacacgaagtttgacaaaatgtaagtgatcaagtgtaaaacgccgctggcctggcactcagcggcgttttttattaaaaaggcgagagtcatactcctgtgttcgcaaggcttactccagagccgttctccatgactggttgtcatcaaatggtaaaaaaatcatcatacattttaaggaaaaagaaggatgtcaagttattagaaaaaagtgtagcgtatgtttatgggtactagctctattattgagttgcttaactgcggagtctgctttttactgccggtactgcaatttggtctcaaatggtaaaagttccccgaatttaaagaaaaaggaggagtgttaagttatgtgtaaaaaatgttgcgtatgcctatgggtccttgctttattattgagttgcttcactgggaagtctgcgtatgctgccagcactccaattgcaaaacatgttgggaattcaaatccgcttatcgaccatcatctgggcgcggatccgtttgcgctgacctataacggaagagtctatatctatatgtcaagcgatgactatgaatataatagcgacggcacgattaaggataattcatttgccaatttgaataaaatatccgtcatatcttcagcggatatggtgaactggacagatcacggagcgattcccgcagcgggtgccaatggggtgaatggcggccgggggattgccaaatgggcaggagcatcatgggccccgtcagccgcggtgaaaaagatcaacggtaaggataaatttttcctttatttcgcaaacggcggcggaggtatcggggttctcaccgcagacagcccgaccggtccgtggacagatccgatcggaaaaccgctggtgacgccaagtacaccaggaatgtccggtgttgtatggctttttgatccggcagtattcgtagatgatgacggtaccggttacctatatgccggcggaggcgttccgggcggttcaaatccaacgcagggacaatgggccaatcctaaaacagcaagagtcatgaaattagggcctgatatgaccagtgttgccggaagtgcatctacgattgatgcgccttttatgtttgaagattcgggaatgcataagtataacggaaaatattactattcctattgtatcaatttcgggggcgcgcacccggccgataaacctccaggtgagatcggctatatgaccagctcaagtcctatgaattctttttcgtatagagggcactttctgaaaaatccgggagcatttttcggaggcggcggaaacaatcaccatgctgtttttaattttaaaaacgagtggtatgtggtgtatcatactcaaactgtcagctccgctctttacggggccggcaaaggataccgttctccccatataaataagcttgtgcataatccagatggctccctgcaagaggtagcggcaaattttgcaggtgtcaaacagctatccaacttgaatccatataaccgggtagaagcggaaacgtttgcctggaacggacggattttgacagaggcatcctcagcacccggcgggccggtcaataatcaacatgtcacaaacattcataacggagactggattgctgtaggaaatgcagatttcgggtcaggcggtgccaggacgtttaaagcaaatgtagcgtccgctctcggcggaaaaatagaagtgcgactagacagtgcaaacggtaagcttgtcggaaccttgaatgtcccttccacaggcggaacgcaatcctggagagaaatagaaactgcggtaagcggcgcatccggtgttcacaacgtattctttgtatttaccggaactggtacaggaaacttgtttaatgttgattactggcagtttacacaaagataagcaaaggtacgttttctaagtctataaaagataaatgaaggagaggaaaaaatgatgtcgagcgtaaaaaaaccaatttgtgtattattggtatgtttcacaatgctgtccgtcatgctgttaggaccgggagttactgaagtttcagcagcaagtgatgcaacagttaatatatctgcagaaagacaagtgattcgcggttttggaggaatgaatcacccggcttggattggagacttgactgcggctcaacgggagaccgcttttggcaatggacagaatcagttaggtttttcggtcttaagaattcatgtagatgagaatagaaataattggtacaaggaagtggagactgcaaagagtgcgatcaaacacggagcaatcgtttttgcttccccttggaatccgccaaacgatatggttgagactttcaatcataatggtgacacatcagctaagcggctgagatacgataagtacgccgcatacgcacagcatcttaacgatttcgttaatttcatgaagagtaatggtgtgaatctgtatgcgatttctatgcagaacgagcctgattacgctcacgaatggacatggtggacgcctcaagaaatcctgcgtttcatgagagagaatgccggttccattaatgcccgtgtgattgcgccggaatcatttcaatacctgaaaaatatatcggaccccattttgaacgatccgcaggcgcttaggaatatggatatcctcggaacccacctgtacggcactcaggtcagtcagtttccttatcctcttttcaaacaaaaaggagcggggaaggacctttggatgacggaagtatactatccgaacagtgataacaactcggcggatcgatggcctgaggctttaggtgtttcagagcatattcatcattcaatggtagagggagattttcaagcttatgtgtggtggtacatccgcagatcatacggcccgatgaaagaagatgggacgatcagcaaacgcggatacaatatggctcatttctcaaaatttgtgcgccctggctatgtaaggattgatgcaacgaaaaatcctgaaccgaatgtttacgtgtcagcctataaaggagacaataaagtcgtgattgttgccattaataaaaataacacaggggtcaaccaaaacttcgtgttgcagaatgggtctgcttcgcaagtatccagatggatcacgagcagcagcagcaatcttcaacctggaacggatctcaaagtaacggataatcatttttgggcccatctgccggctcaaagcgtgacaacatttgttgtaaagcgttaaaggcatcagcattgcattaagccaattttcttactcggaaaagaaaattggcttattttctgtgggagagaatgttgattttttaacgatacacggacattgggtataataatgacaatgacttcaaggagtgatcaatatatgtcacggcttcacagcaaagtattaatcatagacgatgaaaaagaaattttggaactgatcaaaaccgtattaataagagaaggcattgatcgcgtagtgaccgcttcaactgcccgtgacggattggctcaatttcatcaagaaaatcccgatcttgtgatattggatatcatgctgccagacggtgaaggctatgatatctgcaagcaaataagggacatttcacacattcctattatctttttgtctgcaaagggggaggaaacggataaaattgtaggacttgccatcggcggggacgactacattacaaaacctttcagccctaaagaagtcgcataccgggtcaaagcgcagctgagacgggtctcttacttacagccttctcaaaccggaaccgtgataaaaaaagggccatttgaattaaaccaacaacaagccgagctcaccaaaaatgaagcggctattgagctaacacctaaagaacttatgcttatggcctattttctgcagcatcccaatcgggtgatcagtaaagaaacactctatcaagctgtatggggagaagactttttcggttctgacaacacggtgatggttcatatacgcaggctccgtgagaaaatagaaactgtcccatcaaaaccagactttctcgtcactgtgaaagggttaggctacaaatttgttgtaaaggatgcgtaaggatgaattggcgattaacaggcagatacatggtatctgtcatcatagtgaccatcattacagtcttcattaatttatttatttttatgttttggctcgttttacaggcgaacagccaacatgacgaagaaagtacacctgaaactttcacaagatcattcggacaatatgtcacgttatcgaacaagggtatcacagtaaacaaagagggccaaaaagctttaaaagagcagaatgcatggattcaaatattagatgaaaacggacaggatgtttatcatgatagagaacctaaaggactgaagaaaaaatatacgcctattgaaattgtaaatttacataaatataaggatgaacaattattatcaaccatttacgccggcggaaaaaaagtaaacggcaaggagtacagttactttatagggtttaaaaatccctctctcggaaaatttgtcctctcatatgataccaaggaatttgtgacgaagttcaatacaggaaccatcatattattatcaatagatgcattgatcgcgttactcattggctatctattcagccggcagctcacaaaaccgctcggccgtgtcattcaaggaatccagcggttagctaatggagattatacgatcaaaatgaaatccaaaggcatttataaagatgtgttctataatgtcaatcacttatcggaacaactatctttaagcaaaaaagaaaaagataaattagagcaaatgcgtgaagagtggatcagtcatatttctcatgacattaaaacaccattagcatctattcaaggctatgcagaaatcatcaaagatccgaattatcatctcacagtcgaacagatcagagattacgcccggatcattgagagtaaatcgctctatatgaaagatgtgatggaagatttaaatttaacgacaaggctgaaaaacaacgatgtgatgttaaataaagaacgggtaaaccttgtatcgctgctgcgggaaacgttaattgatattttaaacgattcgagatatgcggataagtccattgagcttcaaacgaacctggaaaaactgatgctgaaccttgatgcgatattgattcggagagcggtcacgaatctcattttaaatgccctcgttcacaatgatcccgatgtgaagatcgttgtacagcttgaacaaaaagaacgaactcatgtgacaattaaggacaacggcaaagggatagaagaagaggagctggaaaaagtgtttgatcgctattacagggggacaaatacaggaacgacgcatgcaggctctggtcttggaatggccatagcaaaggatattatccaaaagcacggaggggacatcaccattcacagcaccgcgggagaagggacaacgatagatatacaattatcataatggctatacaaaaaaaacggttctgctgattaataacagaaccgttttttcctattgttccgaaaacactttgattcctttgacaatgttccaaatgaaaaaatagatcgccacaaggaatgtaacagcataagtcgcaagcaggaaaggcccggcatgtctgatatcattcataccaagtaaacctgaagcgatgatgccaattccaaaaatcaaataaggaatcagatgcgtccacaaagattttttcgcatgttctttcacatcgtcccggcttaagaaatagacgataatcggaaacagaaacggcgcaaaaaatatactgaagtaacataatgaagacaaaattttattttctctcaaaccttttcacctctatgatttattgaagggggaattcttctggctgaatcccacactgaagtacaatcttattgtacaactccaaccttaacccgtattaatccgaaccttacatcaaccttaaattaacaaggacgggcaagggctcgtcttcttacagcaatcataagattcaatgccatattgagactcatcacattacatttagagcgtctacgtcggaaatacatttaatttttcgattcgattgaaaaataacgtgtaaagtcccgattcagtccagttttctttgttctatatgtgtcaggtgtgtcttattcaatagagttagagcaaattgacaggcttttaaacctcccaaaaacaagaaattaggttgatagacaatcatgagaaagatttttacaatgagttcgagctcataagaagtgaagagccaaaataatgcgaaggaggaaaagatcagatatgaaacggtcaatttctatttttattacgtgtttattgattacagtattgacaatgggcggcttgcaggcttcccaggcatctgcagcagggacaaaaacgccagcagccaagaatgggcagcttagcataaaaggaacacagctcgtaaaccgggacggcaaagcggtacaattgaaagggatcagttcacatggattgcaatggtatggcgattttgtcaataaagacagcttaaaatggctgagagacgattggggcataaccgttttccgcgcggcgatgtatacggcagatggcggttatattgataatccgtccgtgaaaaataaagtaaaagaagcggttgaagcggcaaaagaacttgggatatatgtcatcattgactggcatatcttaaatgacggcaacccaaaccaacataaagagaaggcaaaagaattttttaaggaaatgtcaagtctttacggaaacacgccaaacgtcatttatgaaattgcaaacgaaccaaacggtgatgtgaactggaagcgtgatattaaaccgtatgcggaagaagtgatttccgttatccgcaaaaatgatccagacaacatcatcattgtcggaaccggtacatggagccaagatgtgaatgatgcagccgatgatcagctaaaagatgcaaacgtcatgtacgcgcttcatttttatgccggcacacacggccaatctttacgggataaagcaaactatgcactcagtaaaggagcgcctattttcgtgacggaatggggaacaagcgacgcgtctggaaatggcggtgtattccttgaccagtcgcgggaatggctgaattatctcgacagcaagaacatcagctgggtgaactggaatctttctgataagcaggaatcatcctcagcgttaaagccgggagcatctaaaacaggcggctggccgcttacagatttaactgcttcaggaacattcgtaagagaaaacattctcggcaacaaagattcaacgaaagaacgccctgaaacgccagcacaagataaccccgcacaggaaaacggcatttctgtacaatacaaagcaggggatgggggtgtgaacagcaaccaaatccgcccgcagcttcacataaaaaataacggcaatgcgacggttgatttaaaagatgtcactgcccgttactggtataacgcgaaaaacaagggccaaaactttgactgtgactacgcgcagattggatgcggcaatctgacccacaaatttgtgacgctgcataaacctaagcaaggtgcagatacctatctggaactgggttttaaaacaggaacgctgtcaccgggagcaagcacagggaatattcagcttcgtcttcacaatgatgactggagtaattatgcacaaagcgacgattattcctttttccaatcaaatacatttaaaacaacgaaaaaaatcacattatatcatcaaggaaaactgatttggggaacagaacccaattagttaagctttaggcggacatcagcaacgatgtccgcttttatcatcttaaacagcaatacatggaggtttacgtgaagaagtagatatgactgtacatataatgtaatcgtttcacagttttgaaaagcgtttatagcgcaatgtatgtattttacacccgccacttttattacttaagggggaacaagagaatgaaaaggtatgacgcatttccagagccaaccggcggctatactgtcggccgcacacaactggattttgagtacacggcatcagatcatacaaaaagagaactgacggtgtttgtgtactatccgtccgacagcagcgaagggaagactacatcaacgtacatgtttcctgaagtctgcgaaatgcttgatgagcagccgcttctcactgcgcggaagaatgcttactctatagatatcaagacccaatgttacgacggccttgctctctccgggaaggaaaaacgctatccggtgttattctatgtttgcggcgggggcggttctccagaatggggcacagtgatctgtacagacttggcaagcgtgggatatgtggtggtaagcatcggccatcagaatagcacgatgtataagcgtaaagatgggcgcccgtttaatgtatcaaaggattttacgtagaggttttttaatattaccttacaaaaaggggatgctgttagaatatggacccacttatatattctcttcacaatttctagtttacataatatatattctaggaagttatacagagaaatgaattacaagtctcataaaccaagtatactttagttattgagacaaagaagagaaatttataactgcaataaatgtttacagcgctagttttgattcagctgaaaaacctaacgcaaaagcaagcttgaaatgaatttcttgtttggtcattacccgcaatgagatcatttctttaggcaagcatataaaaaatcaggtctgataatactttgccgcatcttccctgcttttttccgcgtaatcataaacaaaaagaacaagattttcagcagggccatctgcccggctgccttcatcataccgctcaatgtaggaatctttgcagccgttttcatttcacgaatcgtgagagacaggcaaagaccgcaagaccgaggccgctcccggtccaaaacgacaaaaaactttctccataagataaacgtgacaatgagaaaaagcaccttgtctttcgtaacgcatcacatcctctaatatgaattgacttccgggtgcattatcttcttcctatctattcatataatgagaaaaagccgcctgataaacagacggctctgcagcttattatttgcttcggttacctgcggaagcatgagtgatccgataatgcacagttaaaaatttcagtccgaacagccacatatgatgaacggccttcaggcttgtttcgctctgggctgaaataagaaatgtctctgccagcggaagatgacacgtcccccatttcgtctggagataaatcccttcatcacccgctccgctttttcgccgtctgcttgtcaaaacaagattctgcttacgcgcataaggctttaaaatgcccgtcatttggccgtacggcagaggaagagagatattcatgtatccttccccttttgacctgtatgctgaatacagcgcagtaaaaacggtttcctgcttttcatttgttctgatccatgcacggacattttttctgccgtctttatcagagtcaactcctataatatcactgtgcatgatataccaatccggattcatggacagatgaatctgtcccgctcttctgctgaacggctcgtacacgcgcgcgaacggacgaaaccaaccgctccacgtcactttcgccatgatgtcataatcaattgtcttttcataaaaggaaataacggccggcgccagcttttcagttgaaaagtcttcagaatgcagttctctcagctgatcctgaaggccggtataatggatgtcatttgctgcatgaatgtcagtcaaaaaatctttgcctatcgttcccttcccgtaaattctgctgaacgttctttcactgttctcatcgaacggtctaggattttctattctccaccccgccaaagccggcaggataacgccaaatgcattgacggccccgtgaatccaaatcatctggctgatcgtgagcgttgcctcctcgcggtagacaccgtacgaatatatcaaagaaaaagcaattgtgatcattaacacagccgaagaactcctgatcaagatcctgcctgttttcgtaacaaacggcgccttaaagacgagatatgcatttacatacagacccgcaagatacagagcgacagcaatcacatcaagtgtctttgaaaatgtaatccccaaggcaattaggaccggcgaaatcaaaataatgactgtgctccaccggtaaagtccgcgtttctcccgtatgatcctgccgagcaatccgttaaagatcggaatgagaaaagcggaatagtgaaagtgcaccgccgtcagcagaacgataagcgggccgaaattcaggacgggaatctcaaggacatatgcgaagaaccagaatccgcccccggccaaataaatgaaacccgccataactgacatctcttctgttctgtgaatatttgttttcatcagccggcggacagcatacagtgccagtccaagcgtataaatgaaccacacaaaggcaaaaaagctgaagcctgtgacaagcgcaagcgccgcacatatagcggcaacaggataactccgtaaccacacattctctaaggtctttgacggccgaaaagcaaagcagaatacagcgggaacgaaaaaaagcacggaaaataaaacaaacgtctcagcagctgatatatgcggagcttcagccgccgcaaatcccaaaaagcaaaccacgcttaccatgagatgacgcttcagcatgtttctccctctgtttcccggaaagtcccccggtaagagaaaagcgtgccgagtatccggtttttcacatgaacctttatgctgaagcaattcatttcctcatcataagcctcataaacggttgaattcccgcacagccatgccggaatcgggattttctttccgcctatcaggagccactgccttccggatgtaataacaagccctccgtctgaagacgcttctaaatgcagttcagacagtaggatgtgaggtttgccgaagtaatcaagaattctgttttcccgctcatcatattccatgaccgcatcaaaaaaacgcgttttgcctttaaagaaaaaggtacgattccattccacgccattttgcctgtttttgttttcgatagtaaaagggatatcgtttcccctctctgagaaaaaacatctgaaaaaaacaccggtctttaaaagcattctgacaagaaaagaacctccctttatttctgacataacgccttctccgcaaaacgtgcgtgatccgtcaaatctgtaccgtttctgcagcatcgggtgcagtgattgataatgagtaatcgttttttcatacattgaatccgtcatttcacttctctctttcgttttgtatgccaggcgctcggcagcttgagcttaagaatcatgccggctatcgtaaggactcctaatgaaatcaagaatccgccgccggaatataacagtgccgttacacaaaagaagactgactgcccggcgtgaatcagccactttctccgcatgggaagcagccataatacccctaaccctgtctccagcgttcccctcacgatctctgcatcggcacagccatcatgaaagccttgaaaaaaccaatacagactgaatacgaggcacatacagacatagacaaatccgaaacggaccgatatcttcggatgtctgttttgttctatccaaagccgcaacgcatcaaagctccatgcggtagcccagcttagcagaggacgaaataaaaaccggtctatccaacttcccggcagaccgcgggccgtttcatattgatattgagtcaaaaatgaggtttgtccgttatcccgctctgtatacttccagtagcccctgccttcttttataagtgacagcggatgatcagaggcaaaagcgagcgaagacactctttctgacaagcgaggccttatgtcacctattgattcgcccgtgccggataccttcagcccaaaaccgattcgtgtttcatatagaaatctctgcggttcatctggcagcctatgaagatatgtaatgtcagaaaaacgcagatcccattctttatgaagatgcgggttttgcgtatattcccaaagcgtttctatatcagatgcaatattgatttcgacatatatcggcttctgtttcatgctccctcctcttcccttcttttgtaaacaattcctatattatcataggaacagatcaagcgggagaacgaaaaggccatcccgttatcggcaggacagcctcagtggctttgatgacttatgaataaggtatcgtgtcttttttatcttcagaaactgtttgaatgataatcggacgcacaaaacggattaccgcagccgaggccaaaacagctaatccgcctgcaagcaaaaacgcccccgagaatgatccgcttttatccgcgataaagccggttaaagcaggcccgataataccggccgtgtttgcaagaaaatgcataaagccgccgactgacccgacattcctttgatcaaccacatcgtgaatcaccgcccaatagatagagcccgttatatataaaaagaagactgataaagcaacgagaataacggcacttacggcagtggtaacaagtccggcaaatccgatcagtacagcggaagcgaacaggcaagtgacaagaatgactttccgtgagaacaaaaccccttttccggcggtttttttgtatacataatcagaaatcattccgcctgccgccaaaccgataaatccaagaatccagggaataacagtcaccacgctcataaattcaatacttaatccgcgttctttcaccagatagctcggaaaccatgttaagaagaaaaataagatgtaattgtaggcgaaaaaggcaaaagccgtgaagagaaccgttttttgttttaaataaaaggtcatcgggatatgctgctcatgcgattgaaccgccgctttcattgccggggtgtcttccgtctgtgccggccgttctttgacaaatttaaaccagataaacgcccagactaaaccgacgatcatgatcaggacaaaggaaaccttccagctgaatgccacagcaatcatcccgacaatcgggccggaaatcgctccgccgagcggcgtgccgctgtttgtcaggccgatgaccgtggcgcgctgagacggaggaaaccaattgttgaccattttgcttatggcagccgacagcggcccctcgcccataccgaataaaacacggataatcaaaagacttacaaatccgaaagcaagcgcaaccgccccgctgaaaagagaccaaacgatcatcgccgtacacaatgtcaatttagccccgtaccggtcagatgcaacaccgccaaggaagttacacacagcgtatccgacagaaaaactgctgaaaatcagccccatttgggttgcagacaatgtgagatcctgctgtatgaacggcgccgcaatagacagcgctgaacggtctaaatagttaatcaccccggctgaaaataaaagaagaagaatagggaatctatcctttgagaacataaaatccctccctcttatttcataatttaaattgccggagtaaaccggtttatgtaatgaaaccggttatccggattgccttgccagaagcgccggtttatagcggtgaatccgtttttcaccgctatctttttcttgtatctggcaaagaagaaggcttcccgcttttcgcgccatttctgccgcaggctggacgatcgtcgtaatcggaggagtaaaaaaacccgcaaaaggaacttcatcaattccgatgacggctgccttatccgggattgtcatatcatgctccttcatatacttcagcacctcaacaagaacgatatcgtttgccgccaatatcgctttcggaggctcctgaagtgagaacagctctgacaaaacattggaaatatcagccgcatcggctgttttgatatattcgttccgcaccatcatcccgtgggggtcaagcgcctttttatacccttcaatccgctctaccctcggactgatttcccgaataatggacgtcgtaataatcgcgattctcttaatgccgctctcgataaaccggtcaacggcaagaccggctgcatgatggttatcaagcatcactgtcggaatcccgagttcttcaatggttctgtccataaacacgaccggaaacgtatcgcgtttcatcttttcatataaggagagattttcgcccgtcggaaaaataataattccgtccacctgcttggccctgagcatttcaatatatttcttttctttttccggttcatcatccgcattgcagacaataatatgaaatccttgttcatgaaaatagtcttccaccgccctgatgacctgagtggaaaaggtgtgaagaatattagccaccaccacacctaccgtaaatgttgatttctgttttaagctgcgggcgacgaaattcggctgatagttcagctcatgaatggccgcttctattttttgtttcgttttctcgctcatatagtcatagcgctgatttaaaaattgagatacggtgcttttagatacgtttgcatatttcgccacatcagaaattgtaatggttttcatagactcatccccgtctgtcttcatttttcactagtataagtcagaagtaaatagtttacaatctgacagggaactggattctgtcacactcccgaataagccataaaacctccgtcgacgggaacggtgaccccggtgataaagcctgagtatgaatcatccgaaagccacaggagcgttcccagaaggtcttccggtttcccgaaacgtttcatcggtgtatgtgccataatcttattggatcggtctgtcagacttccatcttcctgtaataacaactcacggttttgcgcagtcaaaaagaaacccggagcgatggcattcacccgcagcccttttttcgcgaaatgaacagccatccacatcgtaaaattctgaaccgccgccttagccgcactgtaggcaggcacctttgtcatcggtgtatacgcactcatagaagaaatattaataatcgcgggacattccgccttcaaaaggtcttttccaaacacttgcgatgccagaaatgcaccggtaaagttgcttgaaaatacgctggaaaatcccgtttcgtccatatcaaaaaatgatgggctctgctcatcctcttcatacgtctcattggcagtgatcgcatcagcgtggtttcccccggctccgttaattaaaagattgacagagccgaaccggctgataatctcgtcttttgccttttcgagcgaatcacgggctgaaacatcagccggtacagaaaccgcggttcctccagcatcagcaatctcgcccgccgcacgctctgctttatcagcattccggctgacgatcgcaattttcatcccctgccgtgaaagctcctttgccattgctgaacagagaacaccgctcccgcctgttatgacagcggttcttcctgataaacgtccatgaatcggtctcatctcttcacctctttctcatgagacgagaacgcatcccacagtccgctcaagtacataattcctaaggcacgatcatataaaccatagcccggccggcattgttcgccccagatatgacggccgtgatcaggccgtacatatcctttgtagccttggccgtgcaattcttttaccacaccgataatatcaatggacccatcactggtaagatgcgaagtttccgtaaaatcaccgttatcgcagattttcacatttcgtatatgggcaaacggcgcagctcccgcatagtgtttggcgatcttcaccatatcattggcgggatccgctcccatcgaacccgtgcacaacgtaatacagttggcgggtgaatctgaaatctctcgcagcttttcataacttttctcaccggtgataatacggggcaggccaaaaattgaccaaggcggatcatccggatgaatggccatttgaatgccgtgttcctccgctacaggaaggatttcatgtaaaaagaattctagattggcccaaagctgtttttcaccgaccgtttgataggcttcaaacagttccttgatccgggccattttctccggctcccacccgggaagcgtcaaatcagaagattcttcaaccgtgcggatcagttcttctggagggagactttccactttcgctttttcaaaaaacaaagcagttgacccatcctccagtgcgcggaacatatcagtacgcgtccagtcaaaaatcggcatgaaattgtaacagatgactttcacgccgaattcggacagattgcgaatggtctgtttatagtgctcaatatattgtccgcgttcttcatggccgagtttaatggcttcatgaacattcacgctttccacgacctctgcatgaaacccataggattgaatgaatctgacttcggcttcaatgtcctccttttcccatacttcgcccgcgggcttctggtgaagagcccagacgatgcctttgaccccgggaatttgtctgacatgttcaagcgtcaccgtatcattaccttggccgtaccagcgaaacgtgatattcatgttacacccccgtatattcgttttttcggcagacgtattctttgctgagggatacggcagcttcatagccgcccttttgatatgcttttgtcaagtcgcttcccactccgaccgcgaccgctccggcagaaagccagtcattcatgctgtttaatgagatacccccggtcggcataatgcggacattcggcagagggccgttgaccgacttgataaatgagggattaaacgaattagcggggaacagctttaccacatcacatccggcttcgagcgccaaagccatatcagacacgctcatgcatcccggaagatacggtacgctgtactggttgcatagagatgctatctcttttacaaaatgagagctgacgataaatgaggcgcctgataaaatggcgtgtctcgctgtttcggtatccattacagaaccggctccaagaagaatatcttgatgccggagttccttaaagacatcttccacttcaggagttgtgtatgtaagctcaatggcgctgatacctcctgaaatggccgcttttgaaacttcaagcgcctcttggctgttttgtccccttatgacagccaccacttgtgcatgcagaagtttttcgtaaatggcgtacttaggcagcattctcgctcctcctttaatcaaacgtaatgattgcttttcccaccttgcccgggtgctgttcgatcaactgaaatgctcgatggacgtcatctgctgaaaatgtatgtgtaataagaccgccgtgcgttaacaggcctttattcagtaagtctgtaatgtacggaaactgattcgtctgcaatcttgaaccggtgatcgtgacttccttttttgtgatcggaagctgagaaatgccggcagtcctctcatcaaaaccaagcacaaccacatgaccggccggagacactgcgtcaattgacgtttcaaacgttgaggggagacagacggcatcaatgacgacattagcgccttcattttttgtccattcgttcacccgcaaaacgggatcttctttttgcgcgttgacggtaacatccgcaccgtttttttcagcgaaggccaagcgttcatcattcaagtcggttatcatgacggaagcgcctttgaactttgccatttttaatatgcagattccgatcggccccgctccttgaatcaaaacggtatcttccttctcgacacggcctctccaaacggcctgggcgccgatcgtatatggttctgccatgaccgcttcctcccagggtagatcgggcgaaacagcatacagctgcttttccggaagcacgatatattcccgcatcccgccatcttcatgaacgccgaacaccgaaagcgctttgcagacgttcggacgtcctttccggcaggcatagcatgttccgcaataagatatcggttcaatcactacccggtcacccggcttgaaacgccggacatgagaaccggtctttgcgacttcccctgtgacttcatgtccgattactctcggcagggacgctaacggatttgtcccatgataaatatgcaaatctgatccgcaaattccgacccgattcaccttgacaagaacatcatccgcgtggacaacagacggtttctcacattccgtcaccatcagatcaaatgctttccgtacttgaaccgctttcattttttcacccgctttttaagttgtgcttgctaccgttcaatcacagtctctttgtttacaaatgacagaacctcttctaggcagggaagcccttcattgtcaccggaaactgtggtgacgagcgcaccgactgcatttgcaaactccagacgtttttccggttcaaaaccatgtagataactgtacaggtagccggcattaaagccgtcacccgctcctaccgtgtcgacaggcgcaaccgggaaagcctctttgtgaacccacttatgatcatgatacagcgcagaacccgcttcaccgtcttttatgacaagctgactgattgaatagctctctgcaaaccgggctaatgcttcattttctcctatacctgtcagctgtttcatttcgtcccggcccgccagaagaatatcagtatgcggaaagatttgatgaaatgccgcacgtgcctcctcaatcgtccacagcttcagcctgatattcggatcaaaagatacgggaatctttcttgctttggcgatggaaagcaccctttcagcaatttcaagatttttcttaccaagcgcgaggaacacaccggtaagatgaacgatgtgaatgccgtcaaacatattctcagttatatcttccggtgcaagagtcagaattggtgaattgaaacgataataaaacgtcttgcctgaaccgtcatttctgatctctttgacatttaaagatgtaggaaagccttcaacaaaggagacgtcagtcacatcaattccttctcctttggcaaactgataaatcactctgccgaactcatccttccccagtctgctgacccactttgagtgcaggttcaatctggcgcatgcaatcgcaaaattcagttcagctcctcctgcttttcgttcaaaatgggtaacaaaacgcaaaggtcctgtgcttgcgggatttaaggtgatcatcgcatcaccgatcgtaaaaatgccataatcagaagccacatcaatactcctttcctttaagactaaatcggtttggtaaaccggtttagttaaactttatatgaaagcacttacatatacaagagaaaaatacaataaattcaaaaaaatctgtttccagtaaaaataacccggtttttcacataaaaaacccctcacaacaaaatgtaagggggttttttgaaaattgtatgcatgtttcctcagttagcagtcttacgttcagggcttgtaccttcttcttccgcccatgtttcaatatgcttgagctccggagtattctcggctttgaatacgggatcaagaccttttttgcgctgagcggcataatccttatagatcttgtaggctacattactcagcagtaaaattgccactaagttaatgagagccaagagacccataaacaagtttgccatgtcccagacgatctggaagtcagccaaacatccgtataccaccatcactacgacgaatacgcggtaaatattaagccatgttttgcttgttttaataaattcaatattcgtttcaccatagtaatagttgccgacgactgagctgaatgcgaataaaaacatcgcaatcgcaataaatgtcggcgcccatccgccgagatggtgctgcagtgcggcttgcgtcacttggatgccgtcgcctttaggcgtaacgctgtacaataaaatgataaaagcagtcgatgtacaaacgataaacgtatcaaagaacacgccgagggtctgaattaatccctgcttagccggatgcgacacatgtgcagctgctgcggcattcggcgcgcttcccattcccgcttcgtttgaaaacaggccgcgctgcgctccgataataatgatgcttcctaagcttccgccgacgatctgctcaagaccgaacgcatttttcacaatcgtaacaagcagctcaggtaccgccgaaatatttacaatcacgacatacagcgcgatcagaatatacattcccgccataaccggaacgattaattgcgagacggaaacaacacgcttcagaccgccgaatataatgaaagccgttaatacagctaaaatgattgcgataactgttttattcacatggaatgcttcgtcaaacgccacagaaatcgtatttgactgcaccgcgttaaatataagtccgaaagaaacggtaatcaatacggcgaataaaataccgagccagcgggcgcccagtccctttgccatgtaatatgccggaccgccgcggaattcgtcaccggaacgcactttatacagctgtgccaaggtgctttccacaaagctggaagccataccgacaatcgctacgatccacatccaaaatactgcgccgggaccgcctgttgcaatcgccagcgcgacgccggtcaagtttccggttccgacacgagaagctgctgagataaagaatgcctgcattgaagacactcctttatttccttgcggcttctccccgacgattctgaacatttcaaaaaagtactggaattgaataaagcgaaaacggaacgtaaagtacaatccgatcccgactaaaatataaacaagatacttccaaataaaatcatttggaacatttatgatttcactgatgaaagcctccatgtttaacctcccttttacatatcttttactgtcatttttgctgtatatgttagatcttttaacacaacgggtattattatatcacaacaacagtggttgagaagtttttttaagaaaatgtttcggtttcttcatcacatcttttgctgtcatgccccgttttttatcttacagcctgaaaaatgttgtcacgttataaggaatgcgtgcatatcataacaaataggtctttaagaaaaaagagatgaaaagatggatggaatggtatatacttaaccaggataataattttttaaatttaataaatgtgtttactttacatttaaattagggtattataataaaaatattcagacttatgaagggaggagaacatttgaaaaaaatcttgtttttaaaagcttctattttatttttagcgattgcaagctttcatttgctctccattccccatgcgtttgataccgctcatcattttaaagcggtagccgaccagcaggaaatgcacgaaatgaaggccggccaaaatgctgatgatgagaaaaaatcgctgacgggctcatatatcttgacggcgctttttgccgcttctgtctcactgattgtgatatcagacaggagacgccccgcttcccggagaagacagcgaaagaaaagctttttaatcgctaaattttatcagtcctcgtatttcgatgagcttcatgttcaacatcgcctatctatgtaacataaaatgaggaggttgttaaacatgttgtttatcttacgaatggtgattttagggttgttttcattcactgcattgaatttatttgtatggcagggaatcgaagtcattcacgctatcactgacttattcggcagccatgaaagctaaatagtaaaacctccgctcaatgagcggaggttttttattttatttttactcttaaacatcgtatgcagggatacgccatacatctgttaccggccctgtctcatcttcatcggtaaagaaggagccgttgctgtatcggtcattcgcccgcaaggacttcacggcgatttcgattctctcgcctttttctgtttccgcagcgatcatgtcggccaaagcgcacgcaaatacgccgactgcccgatgcgggttcttttttagctcacgcagcatgatgacaccgcgtttcgccctggatgttttttcgaattcagataggttcatccgtttgattgctccccgctgtgtgacgaggacaagcgaatctgtttcatgcaggatttgccctgatacgacggtatcaccgtcttttaaatttatgccctttacgccggccgcacgggcaccgactacatttacttcatcttcaccgaaccataaaccgtacccgaggcgggtggcgataaacagctggctgccgccgtctgtgacatgaacatcaatcagctcatcatcccctttaaggttaagggcaacaagcgctttcgagtaacgctgcgctttgtaatgcgtcatttcagttctcttcaccataccgtttttcgtcatgaacagtaaatatgaagatggatcaaattcttttaccggtatagctttcacgatggtttcatcacggtcaatcgtgatgatgttcgttacgtgctgccccatgtctttccacctgatatcgggaagctggtgaaccggacaataaacatagcttcccttattggtaaagagcagaagaacatccgttgtattcatttcaaattggtgaatcagcctgtcagtatccttcataccgaaatcctggccgttagaagcggcaaatgaccgctggcttgttcgttttacatagccgtcttttgtgactgtcacatatacgtcctcagaggcaaccatgacttcaagattgattttaatttcctctatcttttcttcaatgacagaccgtctgctgtcagcataggtctttttcaattttttcaggctgcttgtaatgacttttaacagctttttatcatgacttaaaatggcttcgagctcctgaattttcttgctgagctcttccgcttcctcttttagcgccgtaatatccgtgtttgtcagacgatacagctgcaaggatacgatcgcttcggcctgcggctccgtaaatgcgaatttagaaattaagttttgtttcgcatctttcttgtcgctgcttgcccggatgaccgctatgacctcatctaacacggacagtgccttcatcagtccttcaacgatgtgatgccgctcttttgctttttgtaattcaaagacggagcggtttgtcaccacttccttctgatgggaaatatacgcatccaggatggccgtaagactcatcagcatcggccggcggttatgtatggcgaccatattaaagttatatgttgtctgcagatcagtgtttttatataagaaattcaggatgccttttgcatcggcttctttctttaactcaacgaccacccgaagccccgtgcggtcagtttcatccctgacttcagaaatgccttcgacttttttgtctatgcggtattcgtccattttcttaacgagattggctttgtttacttcaaacggaatttctgtaatgacgatctgctcccgtccgcctcttacggattccacttcagccttgccgcggataataattttgcctttaccggtttcataagccttccgaatgccgtcgactccttgaataatgcctcctgtcggaaagtcaggccctttaatcacctgcatcaagtcatcgacagtgcaatccggagattcaatccgtttaatgacggcatcaatgacctcacccagatgatgagggggaatatcagtcgcatagcccgctgaaatcccggttgatccgttaacaagcaagttagggaacatggcgggcaaaacaaccggctctttactggtgtcatcaaagttcggaacgaattcaaccgtatttttatcaatatcacgcaaaagctctgacgcgatagaagataatctcgcttccgtataacgcatggcagccggcggatcaccgtcaatgcttccgttattgccgtgcatctcaatcagcacattccgcactttccaatcctggctcatccgcaccatcgcttcataaacggagctgtcaccgtgcggatgataattaccgataacgtttccgaccgtttttgccgctttacggaaatttttatcgaatgtatttccgtctgcgtgcatggcgtataaaattctccgctgcaccggctttaaaccgtcacgagcgtcgggcagcgccctgtcttgaataatgtatttactgtagcgtccgaaacggtcgccgattacttcttctaacggtaaatcatgaaataattctggctgtgccactattaaacctcctcagcgaccgacaagttttcattttccaaaatattgctttcctcatctaatccgaaggcaacattcttttcaatccattttcttctcggttctactttgtctcccattaatgtcgttacacggcgctctacccgtgccgcatcgtcgatcttgactctgacgagcgttcgcgattcgggattcatcgtcgtttcccagagctggtctgcgttcatttctcccagacctttatagcgctggatggtatatcctttgccgactttctttaaaacgccgtccatttcttcgtcggaccaagcatattcaataatctctttcttgccgcttcctttgctcactttgtaaagaggcggaagggcgatgaaaacttttccgtgctcgattaaaggtttcatatagcggtagaaaaacgttaacagcaagacttgaatgtgcgcgccgtcggtatccgcgtccgtcatgatgatgatcttgtcatagttgatgtcctctatatcaaaatctgcgccgacaccgccgccgatcgcatgaataatcgtattgatttcttcatttttgaagatgtctgcaagctttgctttctctgtgttgatgacctttccgcgaaggggcagcacggcttggaatttccggtctcttccctgttttgcagagcctccagcagagtctccctccaccagatacaattcattcttcgccggatttctggaaccggccggtgtgagttttccgctcagcgtcgcttctgattttttgcgctttttgccgcttctcgcttcttctctcgctttacgggccgcttcacgggcctggcttgctttaatcgcttttttgacaagcagggttgccgtatcgcggttttcttccaagaaataagcaagattctcagaaatgacggcatccgcggcggatctcgcctcacttgtgccgagcttccctttcgtctggccttcaaattgcagcagttcctccgggatacggacggaaatgattgcggacaaaccttccctgatatcggcgccttcaaggttcttgtctttctcttttaaaagggcgacctttcgcgcatactcgttaaacgctcttgtcattgccgttttggctcctgattcgtgggtgccgccgtcctttgttctgacgttattaacgaatgacagcatattttctgaatacccgtcattaaactgaaacgcgaaatcgacttcaatgtcatgatgctcgccttcaaaggacaccacttcgcataaagcgtctttttcctcgtttaaataagcgacaaatgcttcaattccgttctcataataaaatacttcttttacgcctttccgttcatcaattaattctattttcaaaccttttaacaagaaagccgattcgcgcagacgttctgacagcgtgtcaaaattataaaccgttgagctgaacattgacggatcaggtttaaaatgggtaagcgttcccgtttttttggtcgttccgattttttcaagtgaagtcacgggcttgccgccgttttcaaaccgctgtttatagacatatccgtcacgctcaatagtaactgtcagccactccgataatgcgtttacgacagatgcgccgacaccatgcagaccgccgcttgttttatagccgccctgtccgaatttccccccggcatgcagcacggtgaaaataacttccggcgtcggctttccgagcttatgcatcccggtcggcattccgcgtcctctatcctgaacggagatgctgttgtccttatgtatcgttacgataatatgatctccgtagccggcaagaacttcatcgacggaattgtcgacgatctcatataccagatggtgcaggccgcgtgcgtccgtcgaaccgatgtacattcccggtcgttttctgacggcttccaggccttcaagcacctgtatggcatcttcgttgtaatcaaattgctgttttctagccaaacgtacaaacccctttcaaaaaacctgctcttaatcattctcttttttaaatgttttcatgtctttgtttttcagtatgcgcaagcttcggtccaattctcctcggactcacaattataaccaatatgcttgatttcgcaacatatttaagcgaatggctcgttttttaggccgcaagacatacattcgaacggcttttcatctttttggtgcccttttcggcagataagaacatgagttcgctttctattatatagctttatgccggccatcgcaaacagactgcaaacccctgtataaaggggtttctaaaaaagctgttcatgctttattgtatctgtttcatcatcatacgcaaagagtattctttcaataaaaaagcaaaaacccctgatttgccaaggatttttgccttttttgttcctattttataacagcgcgggcgacttttatacataaatccattacagccgtccgtcctttgtctgtaatcatgcgatacgcttcttcatttgcaaggccctgctgcgcccaaaaaacgggagcgtccgtctgtaaaaattcttcagcaacgccgggaagctgctcagagcgtctgaacacattcacgatatcaatcggtccctccacgtcttttaatgaagcaacggctttaacgccaagcgcctcatcaatcgttgggttgacgggaataatttcatacccttcatcctgcatcgctttggaaaccatgtaagaagtccggtcgggacgatctgacagcccgacgaccgcgatccgtttgctccggtccagaatttctttaatctctgattttgaaggattttgcatctttaccatctccttttgatatattgtacatgaccgcttcgccggaatcaaaaaaagcgatttgtcagcttaattctcaaaaaacttgtcatcagacggtaacaactcgtgttaaaatagagtgaagggacattgaaaaggagaaatgtagatgttgattgctttattgattattttggcctatgcaataggcagcatcccgtcaggtttagtcgtaggcaaacttgcgaaagggatcgatattagagaacacggaagcggcaatttgggcgctacaaatgcttttcgcacgcttggcgttaaagcgggatctgtcgtcgtcgcagccgatattttaaaaggcaccctggccgcggcgctcccatatttactgcacgtccccattcatcctcttctcgcaggggtggcagcagtgatcggccatgtattccccgtgttcgcaaagtttaagggaggcaaagccgtagccacatcagggggcgtcctgctgttttatgctccgctgttattcgttacgatggttgcagtatttttcgtatttttattccttacgaaatttgtttctctgtcttcaatgttaacagggatttatacgattatttactgtctgtttgtaaaagacccttatttattaatcgtagtgacgctcttgaccgcgtttgttatctacagacacagggcaaacatcaaacggattataaacaaaacagaaccgaagatcaaatggttttgatgaaacttcaattttgacatcaaaatgccatatgcgtttataatagagataatttctttatatgagaaacaaaaagggagtgttccggatgaacatgaaagtaacgaaaggcgcgctggattggtacaaagaagagctcgatctggaaacaggcgaccatgtccgtttctttgtccgttacgggggatgcagcaacgttcagaaaggcttttctctcggcattttaaaagacctgccgatgaacatcggcaccagcacggaagttgaaggcattaccttttttattgaagaaagcgacttatggtactttgataatcacgatttgtcagtcacatattcagatcaggcagaagagccggtatttgattacgtgtaaaaaaaagaacgcagcggatgcgttcttttttttacagcctgaacctttttaggtgatcagtcagacgttctttttctaatatgcttctttgcgtttctccgagcaggtcaaagtggggaaattcatttttatggtgaatccactccggcttcagcccgtactccgctccccatctgatcagtttattgagatcgcttgaaccggccttcgtcacggtcttagcctccggaaagcggtcgtccagccagtaatgcgttaaaaaagcgattttcccttccgatacatcctgcttccatctttccagttccttacgcgtaattccaaatgccataagtgcagccgctccttatttttttgccttttcgtaagcggcatgccaatcaggaaaagccttgcgaaactgaatcggtttgaagctctctttatcaacgcatatatgagaggatgtcgctttgatggcaagttcttgatccggattatagatgtggtagccgtaaacggttttaaatccgttatattcttcaatccaagtatgtacgacagccgtttcaccgtagcggagcggctttttataagaaatgctgatatccaatacaggggacagcactcctctatcttccatatccttgtaaaggaatccgagttccttaatcagcgccgttctgccgacctccatccagactaagtaattggcatgatagacgatgcccatttgatctgtttccgcataacgcacttctatttctttttttgacacatgcaacgttctctgctccctttttatcagattagccccattttatcacaacgagccggaaagagaaaaaaaccaggtttccctggtttttattatgattgatagccgttttctcttgcagccgattcatcctgaatttcactgcggaacgattcaatgctttcattgcgtctggcattcttttcttgaatgcgctgtttttcctcatctgtcgcaaattccattgattctttcgcttcttctatattttcaattgtattctgcaccatatcctgcagcttttcaacgttatcggaacggtcatccggattcggtttttgatcattgtttgtcataatgtctgctctcctttgatgatgttattcgcctttcgtctgcatgacaatcggatgtccgtttgacttgtcatgaaacttttcccctttgttgcgtttatatttaacgggttttgtccctaagtggctcggagcgtattgcggctggccgtctttcttgtttatgcccatgttcatccctccttaagagtatattttgcaaaaggaggtgcaaacatgactgcaaattaaaggttatttttgtttgaaccgctgctccagcttttcttcaagctgattcaaatattccgtattggtcatcagctcacgtttattttccataaccaattcatgaaaagaacgttttcgcatttttttcaatcttctcacctccgtgttttcattcattttttccaatttttcaaaacctaagcccttcacaataaaaaaactgaacctctatttgagatccagtttttctttcatttctttttttgtcatcgtgcctacgcgaatgtgctgaatggttcctttttcgtctaatatgtatgttgtcggataagaaagcacgttgaaatccccgttaattccgcttttgtcaatcagaataggaaaggtcagctgataatgatcagcaaatgatttcacagcctgtatatttttttcagaagacgtaaaattaacggctgctaccgcaatatcaggatattctttctgcagctcctgcatatccggcatttccattcggcacggcttgcaccacgtcgcccagaaattgaggagcactttttttcctttataatcagatagggagatactttttcctgacaatgtatcaagtgtaaagtcaggggctttcatcccttcttctgtcccttctttcggacttttttgcacggaataaatgttccagcccgcatatactaacaacccgataagtaacattccgcccagccatttcgcaagcatcttaagcctcccgcataaaaagagagaaagcagactgctttctctcttttgttcattctgctactgtttcattttatcgcgaagcaccatttgtaaaatgccgccgtggcgatagtaatcaatttccacttcactgtcaaaacggacaacgacttcaaacgtttttaccgtaccgtcttcactgattgctctgacagtcagcaagtcgcgcggacgtacagattcatcaacatccacctcgatgacttccttaccggttaagccgagtgtatccgcgttttcgccctgtttgaactggagcggcagcacacccatgaagacgaggttgcttctgtgaattctttcaaagctttcggcaatgactgttctgatgccgagcaggtttgttccttttgcagcccagtcacgtgaagagcccattccgtaatcttttccggccaggacgacaagacccgttttatcttctttataccgcatgcaggcatcataaatagatgtcacttccccggtaggccaatgtgttgtgtagccgccttctgtacccggtgcgatttggtttttaatgcggatattggcgaatgttcctctcatcatgacttcatggtttccgcggcgtgagccgtaagagttaaagtcacgaggagaaacgcctttttcctgcaggtatttgcccgccggtgtgtcttttccgatcgctccggccggagaaatatggtcagtcgtcacggaatcgccgaatttgccgacaacgcgaagtcctcttaaaggctcaacttttcccggctctacagacatttcctcaaagaatggcgggttttgaatgtaagtggaatcctggtcccacttatacagcgcttcatccgtcgtttcgatttcgttccagcgctggttgtcgtcaaataccgtttcatactctttgcggaataattccggcgtaacagtctgtttgacgagagaattgatttcatccatggacggccagatgtcatcgaaataaacattttgtccgtcatttccgacgccgatcggatccgttttcaggttgatgtttacagttcccgccaatgcgtatgcgacaacaagcggcggtgacgcaaggtagtttcctttgacaagcgggtggatccggccttcaaagtttctgttacccgacaggacagaagtgatcaggaggtcatttttagcaaccgcttcttcaatctctggagaaagcgggccggagttcccgatacatgtcgtacagccataccccacaaggttaaagccgagctccttcatgtaaggaagcagacctgagttgactaagtatccagtaacaaccttagaccccggtgcaagtgaagtcttcacataattcggcactttcaagcctaattctaccgcttttttggctaccaatccggcaccgattaatacataagggtttgatgtattcgtacagcttgtaatagcggcgattgcaatcgcccctgttttcataaccgcatcttcaccgctgttaagtttaaatgaaatttctttgttctcttcagcagcatccgctccgaatccttggttgccggccgggctgacaagatgttttttaaacgtttcctgcataacggaaagcgggattaaatcctgcggacgtttcgggcctgaaaggttcgcttcgatttttgacagatcaatttccacaacgtctgtaaaaatcggctcttccgcgtcaggcgtatagaataaaccgttgctgcggcagtatgcttccacaatatcgatctgctcttcttcacggccggtcagacgcaggtaagaaagtgcttcctcgtcaaccgggaagaatccgcaagtcgctccgtattccggcgccatattggcaatagtcgcccgatccgcaagcggaagctcagcaacaccaggaccgaagaattcaacaaatttattgactacgcctttttcacgcagcacttgagtgactttcagcgccaagtcagtcgccgtcgttccgttaggcaattttccgacaagtttcgcgccgatgacctcaggaacagggaaatatgaaggctggccgagcattcccgcttccgcttcaataccgccgacaccccagccgaggacgccgattccgttaatcattgttgtatgggaatcagttcccaccaaagtatcaggataggtcacaagttctccgtcttcctctttcgtatggacaacgcttgccaaaaactcaaggtttacctggtgaacgatacctgttgcaggcggaacggcctgataattgttaaacgctttctttgcccagcttaaaaatttataacgttctgcatttctttcgaattctaagtccatattaatggctaacgcatcttccgtaccggctttgtcaacttgtacggagtggtcaatgaccaggtcaaccggaatttcaggattgattttatcagggtctccgccgacagaggccatggcttttcttaaagatgccaggtcaactacggccggaacgccggtaaagtcctgcagaataacccgtgacggtttaaacggcacatcgatatcttttaattcagcagtaccccatcttgctaaattttcaacatgctcttttgtaatgacgcgtccgtctacctgacgcaaaacggattccaaaagaaccttaatagaataaggaagttttgaaacattgccgacccctgcgtcttccaatgcttttaatgaatagtagttgtatgttttcccatttgaagaaaatgtttttcttgcttggaaaacgtcttgtgttgcgactttttgctgatttgtcattctccaaaatcccccttcaatgatcaagatcgttctttagatgaatgttcacattccatcacaattttctcacaatttcatcttagtataaaatcatacataagtaaatatcaatgtttttattaaatacaataagatcgtcttatcagcatattttcggtaaattttgtccgattttccgcctcatacaacgggctgtaaagagccatattaatgttgaggtgatgatcatggtaaaacggaaagccaatcatgtaattaacggcatgaatgatgcgaaaagccaaggcaaaggcgcgggttatatagaaaatgaccagctcgtcctgacggaagaagaacggcagaacaataaaaaaagaaaaacaaaccaatagccggaacaccttaaaaaggaggctttaacatgacaaataaaaatacgagtaaagatatgcataaaaatgctccgaagggccataaccccggccagccggaaccgctgagcggaagcaaaaaagtgaaaaaccgcaaccatacaagacaaaaacataatacaagccacgatatgtaaaacagaccccggtgtctgtttttttgtgccattcacccatttaaagcttctgcatacgttatagcaaggctttttaatatggaggaatgcttccatgaatcactcaaaaaacgctgaagaatttgatgatacggaagaatggctgcggcagttttacgaggacccgtatgcttggtatgacgagacgctgccgatcgatctatatgaaacaagccgtcagtatatcattgaagccgacctgacggccctgaagcaggtgcaggcgatcaccgtcactctttcgggaaatgagtttatgctctctgttaaaacgcttgaacggacattaaacaaacaaatggtgcttcctttttatctgaatgacaaacatattttcactgatttcaccaaccatattctgaccgtctccatgaacaaggagcctaatgagactcctgcctcattttcctttcaatttcctctataacataaaaaagccgctttcatccctcaatggaagcggcttttttgtccggtcatatcagtcatataccctcaaagtgaatctcccatggccaaatagcagaatcactatacgatagaatatgttctagcaaccgaattgactggacatctatcattttttctattctttttttcatgtgttcttctattctgtcttcgtttacaatatggttaaagtaaggaggagatagaacaatgctagaaggctggtttatgtggtttattttattttgggtcatcgtgatgatcggattgctgtctatcggcggattttttatgttccgaaaatttttaaaacgcttaccgaaagaagacggccggtcagaactggattggcaggactattatattgaaaaaagcaggcacttatggaatgcgggtgacaaggcgtttttggatgaattggtcgctcccgtgccggagctctttcgggatgtagccaaagcgaaaatcgccggaaaaatcggtgaactttccttagcggaggaagctgaacaaataaatcgtgatttaatcatcaggggttacatactggccactcctaagcgtgatcatcaatttttaaaaaagcatctccgcgaaaaacagattgatcttactccttatcaggccctgctcaaataaaaaacctttccggcggacggaaaggttttaattcatctgaatatcagcggtcttcagttcattcgaaagtttgcggtaagacataaacatcgcgatgcgccacggaacaatcattccgaaagccagaatccaaaacattccgcttaaagctccgtaatcaatcgtcgtgctcaaaatggatttcatagcgattctgataaccagcaaaccaatcaggataaacacaaacgcttttgaccgttttaaatagatttcattatttttaatctcaaatttagatgttttaatcagaaaaatagagaagatcacgcccagcgtaatggcctccaaaaattcttcgcccgtcactctgaaaatcggaaaaaggaacataagcgctcccgtactcatgaaaatcggcgggagaattatttttttaggtgaagcgggcttgtcggaggctttaatcctgacgatcatcacggaaatggccatggccgctgcaataacggatgaaattataatcatcatctttatcattcctttgcttgcacggagtttgatactatatactatactccaaaaacataaaaaaaaccaatttgaaaagagaacacgtttacgttcccgttacccggcctacggcctccagcactttagatgcttcaaacggtttaacgataaagtctttagcgcctaattcaatcgcttccagaacgatccgctgctgccgcatggcggtgcacatgatgatccgggctttcgggtcaaaagctaaaatatcctgcagcgcctgtataccgtttttgaccggcatggtaatatccattgtcaccaggtcgggacggattttttgatatactgccagggcttcctcgccgtcagccgcttctccggccactgtgtaattcgccgtttccagaatctctctgattttcgccctcatgaacttggcgtcatctacaactaaaactcgtgtcatattcccctccacatatttaacattaactagtcttattgtaccaaaaacgaaagggtatataatagttcaaaagttattaatccgttacagacccgtaaatcctccgaaaagatttgacagaacgatcagaatgtagctcatccagttaaaaaacagcataactccgatcagaatcataagaatgccgccgattttcatgataagcagctgatgcttgcgaatccaattcattctggtaataaaaaatgaaagaacaagaaaaggaatcgcaaaaccgagaacatataaaaacatatacggcactgctgaagaaggatttgtatttgccagcgaaaacacggctcctaaaataggcccgctgcacggcgaccagccggctgcaaacgcaagaccgatcagaaccgaaccgataaacccctccggacggcgcttaaagtgaatgcgccgctctttcatcatgaatttcggctgaaacacaccggcagtaatcagcccgaaaagaatcagcatgatagcgccaaactggcggatcgcttcatgatattgggtaaaaaaactgccgataaacgaagttccatatcccaatgcgataaaaatcacggagaagccaagcaaaaaacaaagtgtatgcacgaggccacgcttttgcagcatcaccttttctgttttcacctcgtccatactgacaccagttatgtaagataaaaaggcggggtacaacggcagacagcatggagaaatgaaagacagaaatccggccccaaacgtcagaaagtaattaaaactcacgatgacacactcccttcgagttatgacaaaatcatttcatttttttaacactttcccgagaaggattactttttatagaaaaagcttatataatttaatttgacatcgagatattatactccttcttatttgaaaaacagtataaatgtggatataataatagcgactcaggtgaaagatttatgtatgaaaggatatatccctgtgattagagagcatctattaaatgaaattgaaaaaaaacgggcagagctgcttaaaatcgtcatgacaaacggaatgacatcaaacattacgatagaactcagccaggagcttgaccaccttctcatacaataccaaaaagaactgcacaccggcagttggggtgaaacatgacgcaaaaataaaaaaccctctccgggttttttatttttataaccatgtatctctatatcataatctgtacgtattatttcgcttgattattcatggctttcatcatttgattaattttcttttgagaaggtttcattcccatttgcatcatcatcatgcgtaacatttgttcattaataggcggattctttttcaaatagctcatcatatatttacgagcaataaaaaacccgagtgcaacacctatgagcaatgcgacaacgcccactaggatgccaacccataaagtcattttatttcctccttcatgttgtctagtttaaagtgtactaaaccaaaggctattatacaacatttacatctctttttcctcgtttttagacaaaatttctttccctgaccggatttaaccacccgtagcgccgtgtcttgaaatccattgcaagaaaacaggggctgattttacgcagaatctcaaagaaaatcgtttccgcctcataatctcccgaagccgcaatctcaattaaactgtctttcatcatgaaggtggcgcggcccttttctccgggcagtgtaagccggtaaatggaatccaaacggctgtaactcattcggtttaaatgcagctggagccgctgatgcatatgtatcaccggaatcggttccgttatatattgaacttgcttttctgtcatttgatattcctggggtgtcagatctgtccaatgatagtctcgaaacaactcaaacatagccgtttcccgcccgaagtagtggttcgcaaactcatcctttatcaggtgcgtatagtaatgacgttccatttcctcatccccttttacagcgcttcgttattgctttctattatacaaaaggagaaaagaaagaattgtctattactgttacgccgccccttctatttttgtcgcataaacaggaaaaagaggatgatttgactcatcctcttttgtctcgttatttgtttagaagttttttcacgcggtcaactacgttttctgcagtaaacccgtattctttcataattgtttctcccggagctgaagcaccgaaacggtcaattgcgagaacgtctccttcaagaccggtaaatttgccccatccgaagcttgaacccatttcgatcgcaagacgtttcgtcacattcggaggaagcacgctgtttttgtactcagccgattgtttttcaaagcggtcccagctcggcatgctgactacagatacgtgaatgttttcttcagccagtttcgcttgagcttcgatcgcaagtccgacttcagagcctgtcgctaaaagaagggcgtccggtgaatcggtttttgctttggaaacggtataagcccctttttccacgcccgcatacgcttcttcagcctgctgatcaatcgtcggcaggttttggcgtgtcaatacaagagctgtcggatgatcttggctttgaacggcaaccttccatgcagctgcggtttcatttccgtcagcaggtctgatcacagaaaggttaggaagtgcgcgtaaagaagcaagctgctcaatcggttcgtgagtcggcccgtcttctcctacggcaatactgtcatgcgtgaatacataagtgacagggagtcccatcaatgatgccagacgaatggcaggtcttaaataatcagagaatacaaagaatgtgccgccgaatacgcggaggccgccgtgaagcgccattccgtttaatgcagcgcccatcgcaaattcacggacaccgaaccagaagtttttcccggcgtagtctttggccgtgaagtctcctccatttttgattgtcgttttatttgaacccgcaaggtcagcagatcccccgacaaagaaaggaattttcttggcgatcccgttcagtacctcacctgaagatgcgcgggaagcaaggctgctgcctttttcataaacgggaacttcctgatcccagtctttaggaagctcgcctttcatgccgagtgacagctgttcagcaagctcaggatatttttctttataagccgcgaacagttcattccattcctgttcttttttcgagccggcttcttttacagcttgattgaaatgcccgtatacttcttccggaacataaaaatcttcttcaaacgtccaagcatacgcttcttttgtcagcttgctctcttctagtcctaacggagcgccgtgaacgccggatgtgcccgcacggtttggagaaccgaaaccgatcgtggttttcacttcaatcaaagtcggttttttatcattctggcgcgctttttcaattgcagccgtcaattcagcgatgttgtttccgtcctcaacataaagaacttcccagttcattgcttcaaaacgctgctttacattttcagagaaagatcggtctaaatcgccgtctaaggaaatgtcattagaatcgtataatacgatcaggcggcctaattcaagatggcctgcaagagaagcggcttcggaagaaatgccttccattaaatcgccgtctccgcaaatactgtatgtataatgatcaactacgttgaatgaatcacggttatatgtctcagccagatggcgttctgcaattgccattcccactgccattgcaatcccctgtccaagcggcccggtcgttgcgtctactccggctgtatgcccgaactccggatgtcccggtgttttgcttccccattgacggaactgtttcaagtcttcaatgctgaggtcatatccgcttaaatgcagcatgctgtataaaagcattgaaccgtggcctgctgataaaacaaagcggtcgcggttaaaccagcccggattctgcggatttacattcataaatttcgtccacagcgtgtatgccatcggagcggctcccatcggcatgcccggatgtccggaattcgctttttcaattgcgtctatagatagtgtacgaatggtggcaactgatttcttttcaattgtatccattataatccccttccttattgttgtaccttttcatcataaagcgatgctgactttttctcaactctttcagcttaaatttgagataaacttgttgaaaattgtcgtaaagcacatcctgatattagtatatacgaaaaaagaatacgtattgccgtattctttctgtttagtgaagattatttttctgttgttctctttttaatttttcaggggtgacatcgttgccttccggatcaatcacttttacgctctttaacgtatttttcattgaggagcggaatcctttcaaatactcctggcgaagcttttgctgttcagctttttcctcatccgttattgtgtttgatttagctttttgagccaattcgttaattcttgcgattttttctttagaaatcataataagctcctttggtgcgtgttgattatatactactaaaacgcagtcttttttacaactgatgcgcgtcagctgccttctgtgtctgcggtatattcctgaaaccgccggtgaaccgtggctttggacacgtcatagccgaatcctcttaaggtcgctgcgatttctgcaaaggtaagcttgttggctctcagcctgataatttccgaaaccggaacctcttttttttcttttccgctgttttcatgtctgtttttcagattccgttcaggcttgtagccgtttttcacggctcttttcattccccgccggattttcatattgtgaattttcctctgatattcctcaacaatactgacgatttcaagtaccatcgaatcagcttcggaaagctccagttcacctttatgagccgtcgtatatattttaacgttctccctgtaaatacaatgcaaaagcgcaatcttggcgtttcctcttcccaatctcgtttcgtcctgcaccaatatcgcgtcaatatgtgattttttaatttcatcaagcatttcaaatactccgtcgcggtccatttcgtaaccgctggctttctcagaaatgactttcacgacttccatgccgtttgcagcagcgatctcactgagctcctcttcctgtctttttaatgacgtttgctgctgttctttgtttgtgcttacgcgggcataaatgagcgccttcatttctctctttcctctctaattgacaatggccagctgatatacggccggatgcttcttcttaaccggtagaataagttcgtctccgggctttatatcagcagtctggagatgattattctccgtcacccactcaatgaaatcttctttattaatgtgtttcttttctgctacatgatctgcaagtgaccagagtgtatcgccgtcctgaacctttattttaacatattggctgagggactgatcatttcccgcacatgaaacaagtaaaatagcggcacttaaaatcgcagtaaacagcccgacaaatatgatagattctttcgccatgtaaacaacctccgataagaatgtttgttcgctttttatatctttcagtatatacgaacaaatgtttctgtcaatcgtttttttcgaacctatgtttgtactgtcaggaaaatcatgctataatctacttaaaatcgacgttttgaggtgcgaaatatgacgaagctatcaaaaaggcagcttgatatcctgcgttttattaaagaagaggtaaaaacgaaaggatatccgccttctgtaagagagataggagaagcagtaggactggcttccagttcaaccgtgcacggccatttggcgcggctggagacaaaaggcctgatcagacgggaccctacgaaaccgagggcgattgaggtattggatgaagaagaagtccatattccgaaaagccaggtcgtaaacgttccggtcatcgggaaagtgacggcgggtattccgattacggctgttgaaaatatcgacgagtattttccgcttcctgaccggatggttcctccgggcgaacatgtctttatgttagaaatcatgggagaaagtatgattgacgccggcatttttgacaaagattacgtcattgtcaaacagcagaacacggccaataacggagaaatcgtcgtagctatgaccgaagatgatgaagcgacggtcaagcgcttctataaagaagacaattatgtgcggctgcagccggaaaatccgacgatggagccgattatcctgcaaaacgtaagcattttggggaaagtgatcggcgtattcagagccgtccattaattctattaaacttcatttatcgtaaaaaacccctctgtaaggggtttttttgcataaaaaaagcagattcgccctggcttaagaaacgaacctgctaaggaggaaaaacttacattcttattatccgacatcgcacttttgaagtcaactaataatgtttccctcgagaaacttttcattcatttttcaactttttatatatttgtgcgtgatgaatttgcttttttatcttttctttgggcgggcacgtcaaaaaatttatatatgaatatttagtacatagtgcaataagttaaatataaatataaaaaaacccgctgcctttagcgagtatctattttcaatcaaaatgataatattctacaccgtagaaccctttaatatagacgggaccacagacgtttgaagaactttcaaccagaatcctgtatttgtgatacggatcaattgattttttatcttgggcactgaggtttaaccagctgccgctgtagtttttagaacttaatgtataaaaatttccgttcagcgccatccgctggagtttcatgcttaaaccgcacgaagagttgttcattatggtgaacttatagcctaaaaagtaatcgtcggcagctacagcacccggattttcaatatgaaactcttttgcgtttccctccaaagtgaagcttgtttttgatccgaattcagtggtagccgctttagctgagtgtattccgctaaaacataataaaaaaacagcaatacatatccagtattttttcatttgcatccccctttttacatattttaacttgtgaatcctgtgatgtctattcacattttactttataaccactatatacctgtttaaaaatttgcggattgcttacaatgaagactaaacgaaataacgaaggtggttcaaatgaaacacgtaattgctttcgcttctaaaacggcgctcacacttgctttactgtacattgttctggatcttatgtaccaagtaacctttttaaacgttctgtttattacagtgatcttaagtttaatcacttattttgcgggtgattgcatgattctgccgagaacaagcaatttcacagccgttgcagctgatttcggaatttcattcattatattatggatattcctgatgaacattggcgggtttaatgtctctcctgccgcggcagcggttatctctgcactttgcatttctgtttttgaggcattttttcaccggtatttgcagcaatatgtacttcccgaagattataaggacacaacagagacggatagcacgctatggagctatcaaaccgaggcgtctgaagaattagtgccggaaaaagaccctcaggaaaaaacataaaaaggaggcaatcgcctcctcctctttttacttttgcttctgatcgtcaagcggcagctgcagcagtgagtctgtgcctgtcgctttcggcgtttttccgtcccatttttcaatccatttatatttgatcatttcatcggacattgatttcttaatgatttcgttatagtcagcgatcccttccgcttcaatttttttctttttcgcttcggcttcggctattttaatttcagtttgtgtccgttcaagttcctgtgaagacttcacccttgcatcgatggcttcctgtgtggctttatccggcttcggtacgccaagcgtcagatcatcaattaaaaatccgagactcttcatatcatcagcaaatctcttttgaacatcggccgcggcttcagcagatttttgcccgtatgtgtcaataaccgagtatttgctgattgattttcgcgccgcatcccacagccttgtttttaaatatgtattttcaatcgtttcgacgtctaccgccccgaatttgttaaacagatcgactactttatcaggctgcacgacatagttgtaagcgatatccatttctatatttttaccatcagaggttgccacttttatattttcattattcactgtctgcatacgcaccggatattccgttactttattaaataatccgactaagtgccagccttggtccaatgtgtcggattttaccccgccattcggtgagtatacaaccccgacataaccgttcggtattttttcaatgaatagtgacgctgtgacgcccgcaattaaaagggctgcacctataatcacaccgccgagaattttttttgtgtttccgcgcttattttcgctcatgctgatcttcttcctcccatgacttttttaattttttggctccgcttcccacttgtttaaagattggactaagcatcagccataaaccgaatccgatgatgacaagaagaatgatagacccgatcatcactttcatttgcccacctcttttctttcatcctgtcaattatgtatacgatcttaagaacttaaagtttcataaatttcaaaagaaaaagccccgccgacaaaataagcgtgcttattaataattgtcactgataaaatcagaaatcgtttttgtaaattggtaaaaggtcccgttttgtgcggatgctctgcttttcagcgtaaaggtgtcaaatagtgattttctgaagccggtgctcatttcgatttgaatactcaatccggatgaagattgattggcaaggttgttcggactgacgcctgcgtatttatcatttgtgccaagaagaacggcaggatacccgtgccgtttcagcacatcggtcaagagttcggcccgttctctgtctgtaccgccgatttttatctttttatcatcactgccgtaaccgtgcaatgaaatgacattagagtgccctttcaccatttgcacggccttggtttcatcgaaatgcgaacttgtcaaatgcagagctgcattaccggctgattttaacccttcaaataaatataaactccggttttcggcaatttctctggctaactcactggtccccggctctatgcctccgccgtgtatagctaatatgaggacagaagggtcatgctcccgcgttgaaatggaaaaatcggaaggatcttcattcagctttaattcctcgaaactgccgtaaagatctgaagcggcatcagcccgaaagaacggcagaagcaaaaacggtaaaattaaaattgaaattccttttttggttattgatggcatttgtatgtttatgttacaatacaaatgcttcagcctttgaagcgaacggcagaacagggtgactttggacggtttcttctgctctgcctctttgccggctgctttacggtctactcttctaaccctttttgccataacatcatcctttcttttgtttacacttttgtcacaatattatatacgttggacaaaacctccgttcatcttgaagaataaaaacatcaaaacaacctctatcctttagcctaaaaaagtctttctgttcaaagagacggaaagcttaaatgataaaaatgaaacccgtctccttagttttgtttgatttcccaattcaagaatccccgaaaaaatttgaatgtaactgctgtctccataaaaaaaagactgctgttaagcagtctttttttcgttttatttcgtgcctgttgatcccagtccgccgcggtcattgttcccgagcttgtctacttcgatcagctccacttcaggcattttcttcatgattctgaattggcatatccgctcccccttggaaatgtcggtatcccgaagcgcgaatgcaggaaaaaaccagaagtcattgtcgcctttataagattcatcaatgactcccattgaatttgtctgaatgatcccgaaatgcttatatgtacttgaacgcggaacgacatgggcctcgtatccttccggcagttccatcgcaactccaagcgggataagtttgaattcgccttttttgattgttatatgttcagctgcccgcagatcaatccaatcgccctgttcaattttactgattctcgtttgcgtatcatctgaatatttaattttgatttgtaaagtcatgttcgctgctccttttgcttccctatttcagtcgtattgatgaccaatccgtgccccattataccatttaactgataagaatgctgattttggtgtatatgcagccgaagaggaagcacggcgaagacaatgagaataaacctaaaatgaggacccctcctatcagtttttccctccattttcacatgacagcttcaattacaataatgcaaagctatatgtccgttcctttcaacagagcttttttaaaatttcgcctcggtttcaaaaggaatttcgttctgaataaagaatttgaagaataagcgcttaaagggcgcgcgattcttttctgtcccctgcctcaggcgcttatatcaaaagaaagaggtgtctttagaatggttcaatttaaaaactttcctgatccgtctttaaacgccccattgcagtctcgccctgcacagccctctgaattggagcatctcaaagcaaggatgcagaattttattaagcattccgcaacggatgataatcttgagatcgcagatgcccgggtgacggcggaaggaatggtcacctcacttttaaaagaacggcttgatacagaatacgaaatgcttatgaataaaatcacccgggaagtgaatgtggaggattacggagcggtccctgacggccgggacaatacagaagcctttcggaatgcgatcgggaacggccgggtcaaagtaaatgttcccgcaggagaatttttggttcaagggataaaactcccctcatggactactatttccggtgagggacaagggattaccgtgcttaagcttcatgaggacactcccgcatacgaatgggtcattactaacgatgattacgaaaatggaaaccgtaatatttttgtccagaacatgactttagactggaatcctgaccgtcaatgcggagtcaggaaccccggaggacagtgttccagctgtttaacgtttgctaatgtgcaatacggctggattaagaatgttgaaacggttaacgcgggtctgcatggtatagatattacatctccgacttacgatcatttgcctgaaacagaatggacgaaagacggctgccgttatatatggattgataactgtgtggcatacggcgccggagacgacggcattaccacccattacagcgaatatattttcatttccaactgccattccggaaacccccgcggcacagagcatgctgagggcagcgcaaactcgaacggcattgaaattgacgacggctctaaacatgtgtggcttttaaataactatacgagcggaaatatccgcgggattgaggtaaaggcgcacagcctgtggccggcttctcaaaatgttcatattatcggtcatgtttcgtatcgtgatgtacgttcatttgatattcgtcatatcggccatcatcaggcctcagaccccgaaagcacgacggcttatgatgttactttaaccgattgcaccgcgattgaaccggtattcaatgccctctatgacggtgtaaccccgagggcgctggtcatctctgcctataaaaacgttaatgtaaacggattcacagctattggtgatccctcatacgactatggcgggaatccagtcgtggctcttcaataccgcagtcaaaatattacgatcaacggcattaaaatacgcggctttacacaagccggggttgacatcaatatatccggcggatctaataaaaccgattatgttaaaattttaaattttgatatatacaagtcttctcctaaaggcatcacaatcggcggaggccaatataacgtaaatattatgaacggtacgatgatcggagacggcggttccgtcggaattacgtcccctaacagtcaggctgtcattctcggggtgcaagcggaaggttacagcgctgccgcatctataaaaggacagacttatgagcagatccccgtcaatttaaagggaggcgcacagctcgcgaccagctccggttttgcattcaacccgacaagcgccgttattgcgggaacaggcgatattacggccagaggtgacagaaatgcgatcatcagctcttccggaggttcaagttccgaaggttcaagggcatttatcgccgcttcaaacaatgtccatattacgggcggcaaagtctccagaacgattctgtcatcagaaagcattacattggaagaaccatacacggttgccggagggcatcagtccatcaaatggaaactggattcagcgggcggccacggtacgttcgccggagctgtcacctcttccctgtcagggtacggagaatattttgaaagtgtaaccggccagaagattcccgccgggacgatcgtcacagtgaaaggcgaaaaaattgaaccggctcacgtcggtgattatatgctcggcgtcatttcagaaacagccgcttttatctcaggagccgcaagcttcggatggcaaagccgctttttgacaaatgagttcggcggtttcatatacgaaaatgtgactgacgaagaaacaggagaaacagtacgcgtaccgaaacaaaacccggactgcagtccggctcttgaagctgactatgaagcacgcgcggccagagacgaatggcatattgtcggactcaacggccggcattacgtacgagtcgacagtacggtcagcccgggagattatatcacggctcataacggaatcgggactaaagccgcggaaggctggaaggtattgaaactgacggccttatacagcgctgaaaaagggtacggcattgcaattgcggttatcaaataggatctcaatatcaggatcatcttctctcttttctatcgggcgggtataatcctgttttttataccgaatgagatgcctctttttcagcataccgtttcatttgtccaagccatccatgctttctgtcatagaatactaccgtcagatgaaaaaaggaggaatatgagtatgagtatggacatgggtatggacatgggtatggatatgaacggacattatgatcaccagccaaagcagcctaaacaaaagaagaaaaagaagaaacaagataaaaagcatcttgattatgattacatcgttgtttataaaagaaaatgcaaaaaatgctgctgacttgacatatcaatactttttacacccggtaaatcccgggtgtttttcttattatgacgtttctccgggctattttcacccaaaatccggtcatcctatcacaatacataaaaagactctattattttcttcccttttcgcctgattaaaagtatttcatttacagaaaacaacataaatagaatgacatgacttttgagaaaatctgctctttgcttggtcaatttttctgcgataccatgaatttgcaacaattttaaaaaatttcctcaggaggtcatagacatgaaaatcgccagaacaatagtcggatcatgcttagctttatctctaacaattcctttcacagccagtgcctcagcagccagtcagtctgaacacccgaatgcgcctcacgtttcacccgttgcaaatccgttagaaagtaaattatcccaaacagcaggccaaaacgtaaaagcagcaggtgttgatgccgggctgaacgtaaacgtagatgttctcggaatcgcagatcgcatagctgaagcagttaagtcagatcaaaaccgaaccggctgggtaaaaaatgtcatggaaacaacattttacgcatcaggacagaagtacaacgtcatggtgttcaatttaaatcaagaatatgaagaccgctttaacggcgttcaattttacggatcagccgtttatgacggcattacttacggaatctgggtcttcgaagacggttcctttaataacaaaggagacgggggctggatcaattgggcattcagaggatggttcgatcgtgataatcagcatattgaattccacagaccttaattcagagaaaacttgcggcagcgcccgcaagtttttattttgataacgggatactgtacatttttcaccgttataacgactatacttgaagtgcgggctccgatcgcagccccggtaaagtctttcaaagtgagggtatgccatgtcaaagtctttaaaaatagtgttgtggagcatattggttttcattatcttgttagtgatgatcggaatcgtttcttacaatcaaactccgtctgcagaaagcgcagcaaaaagaatgctttacagcgtctaatcaattttaagccttcatcggctttttttatttaccgcagaacacttgaagttcttctgttagatcgttacgttcccattcggaatggagtatacgcgtatatcaccaggcagtccgttttgatacatggttccgattatgcctttcgcatcttttttctctattcctcatcacatccacttttttcatgctgctgctcttgaaaccaaccaatcatttcttcagcctgttccgttgaatcaaaaggttccaatcctaatagcgtgttacattttcatttttaaaaaaacaagccaactgcgcaccctcttcgcaacttctcaatgtatgagcctatccgtttctattacaggaagcagtacgattcctccttttactcattttaacggatggccatgtaaaggaaatatagactaagaaaccttttttcaaaaagtaaactagcatccctatcaaacttttcatttcggcatagtatgtattaatcctctttaggaggtgagattatatgggattctcaggtggttatggtagctcctttgcgttaatcgtggtgctattcattttattaatcatcgttggggcttctttcctcggcggttattaagaatcctcttacctccgcatccatgtcagcagcacctccatgatcgtacggcgccataaatgaaatgtttatggcgctctgctgtttttacccttttcattcacacattaaaactaaaaagatcggccgatgaacatgcagccgatcagtaattcatagattattgtgtaaggtttacatcgatgacgttatagaaggcattggaagtatccgcaacgtcccatacccccaaaatgacatgatacccgcttcgatcagtcggcacaaaaatcttatgagtcagattcgtatctgccttggaaccgtcgtggtttaccgttccgattaattcaaattcatctcttgacaaaggtttattcggattccagtttttcttggtgatataatagtgccactttgatgtcgcatgaggagctgtgtagtaccaagtaaaggtgttaaaaccgccgcggatgttttgttttacccaataatctgcagtctgcttgtctaaaccgaagtcaatttgtcccgatcccccatttgcagacgcaattcttccatccggcggacctgcagccggaaatcctttcggcccttctacagactgaggattatcaatgacggagccatatttctgcgcagcggccgtccagcccaatgtttgtttctctaaagctcccatgtacgctctgctgacgggctcttttatatacccgtgcgcagatgcatcacttgaatagaaagcgcctccaatcccaagagtaacagttaaaactgcagctttgaccaaacccttcattactgcatcatcctcccttttttgttaataaaatccctttcggtatatacacttcacgatagaggatgaaatgaccttccttttcttgataggaaaaagcaatgaggttcgcgctttcccctttgttttttataatcataaagaaaaagccgggccgattctgttgtcgaatccgcgattgccaaaaaccggcccgccccttatgctcagaacttcattcgctggatttgcgggtttcttttcggataaccggtgctacttccgctgctaatcgttcgatgttttccgcggcttttttaaacggcatacctcctatatcgatttgcgcgagaaatcgctgatgcccgaacaactcatattgatgcatgattttttcaatgatctgctgtgaacttcccacaaataaagctgtttcttttccggacgcccgctcaaaatctttcttcgttaaaggctcatcgatcccgtgatatgaatgaacgtgagaccagtaatttgaatgatacgggtaaaattcttgtattgcctgttcattcgtttttgaaatgaacatatgtccggtcacggcaaccttcacattttccggaggatgaccggctttagaagccgcttcccggtatttgtcaacaagcggcttagatgacatcggatcaccgctcagtacagccaatgccaaacccgcacctgcacgcccggctcgttctgcgctttccggagtccccgaaacacctaaccatagcggaatgcttccgcaaaaaggccgaggagaaatttctgcctcgcgcagcggcggccggtaacgtcctttccaggtaaccgattcttccccggaatttaattttaaaaaaaggtcaatgtgttcttcaaacagttctttataatggcctacgtcataaccgaaaagaggaaacgagtctaaaaatgcgccccgtcccgcaatgatttccgcccggccgtctgaaatcagatcaagcgttgcaaaatcctcaaataaacggacgggatctgcggtggataatacagtcgtggcactggtcagcttaatattttcagtaatctgtgaaatcgctgataagatggccggcggcgaagataccgcataatcaagacgatgatgctcgcctaccccgaatacatcaagccctgcgtcgtcagccagtttcgccagcttcatcaattcatctatccgctgctttgcgctgactgttttccctgtcagaggatcgggatataattctgcaaatgaataaattccaatttccatacaatcacggtgttcagccctcacatttctctcctcctgcactgtgtaaaaaagcttttatgttattctattcagccgttttataaataggaatttattcaaaataaatacagaagcttaacatgcagaaggccggtatgagaggaaaaaaagtttccggcgcccttcaattctgcccattatactcatgcagccggactaggcaagaacaaagccggcacaagcggattcgaattcatgtgttcgttttcagtccaattcaatccaatcgtgatattgatcataaagctttcctattcttccggcatcaagagcgatgacttcacaccctctgtcatcatatagaaagaaaataatatcttttgtcatattcacaaagaaaacatcgggatacccaacggaacagcccccgaaccttggcttcagcggaaaatcttcgtggacggctgccttaagtaattggggaatacgcagatctttccgtttacataataaagaaaactgctgcatttcatattcttctgcatcatcttcttcaaacggacaggggcaggtcttcacctggatccgatataaatcatccttacacttcagaaacggctgataaacctttaattttctcggatgattaccttgagttttgtgcttatatacgttggcaacaaggaacatgtcatcgctatgttcaaacagttcattgaaaagtgcggcggtttgatgatgaacaagctgaaaatactcaagattcaaagcaccgctttcattaaattgatacatattgccgccgagagaaaaatgaagtcccacgtcccattgatgataaatgccgggcactaattttaaagtcggaaacctttccttcagataatcatttattttcattcaaacatctcactttccgtttcccgctccagagacagaagaagccgaaaacattccgcttatttctttttcacccttgtaatattattccgattggaatacaatgaaatagaacactgtgaaccccattgatcagggtggatgctggtcacattcatcctggtcctttcttttacacaagatcgcaccaactttgatcccctccgtttccaaccttatacatatatttcaatggtattattttcttatacataagcatcaagaggtgtcagctttgaacaacatcagaagatgaagagcatatttccggtctcaccgcaaaatgggtcttgactctgaactgcttttcacattttgattatcaagcgcttctttaaattcatcaaaatgaattgaacattgctgattcaaattacttcctgcaccttctgtcgctaaactgcaaaatgtccgtcacaatcatcctctctctaattttacaacattgctataatgattttcatgtttttcccaaccttcaagctgaatctttttgatcgttactaggtaacctaaatacaaaaaaacctgctttcagcagggttttttcggtaaaggggagattatttccccacaaattctattacctatgtttttgttttaaccattctttctttagcaatgcgtattggtaagtgttttcatatttaggtgttccatcctcgtgggcagtaaatgaaataaattcaagaaaataaccttctttacgcattcctaatctctcacatagtttttgtgacctgcagttatcatcttcaacatatgcataaagccttcttgcttctttttgcataaagagatactcaaagaaagccttcgcactttcacttgcgtatcccgccccttcaaaacgggcattgaaattccaacaaacggaataggtatctggctcttcttttaaataaaatagttctccgactagatcattactgtcttttaaacaaactgcaatataagagtcatctcggcttcttttttgaacatttacggcagcttcttctaacgtagatattctgtcatcaagaaaacaattcactctcggatgtgccgaatattccaacagaccttgtgcatctctctcggtaaaatttcttaaaattaagcgatgggtttcaattttttgcatttgcagtctcctgtttcattgttatcgacctttgaaaagaacttcttcgtttgttgaagaacttatcacaatctatttttactataatgatgggtgttatcatctttgtcaaaaacaataatcattcatttgccgcccgcaatgtaaagtactgaacaattttcgtgaaaaaccctcagtatcgaatataaaaacgagcaatagtaataaaacaaagttaagccattaaaagcttattgagtattttttcaaacttatttacgctcatcatctcatgagtgagaaatgtccccttataaaacatgctgaaagtcgtccaaactgccggggatttttgcgccatatcttttgacgttattctcagggcctgaaaatgaagtcctttcttttcagtcagttcctttaaatgctttaacactccgactgcaaatgggcattgagctgtataaaatattgtgattccctcatcattaacggaattacttttcacctgttttttaaatacaggaggatgtgcatgttcattccacgtcagtgacatcaactgaaaatagggttctgcttcatcttgcacagcaaatcccatatgctcgaagaaatgcttatcacttaaataagggagttttttcttccccactatatgaactatcccatccataccgcgggattttgcatctgacacacatttttctaacaagtgttttgcatgtccgttattcttatatttacctgagacccaaaggcaattaataaacataaaattaggtgcgcttaccgggacccacgcttcttctgcaggtaaatattcaataaaaactttggcccgttcgtttaggcggtagaacaccaagccatcactcatccgatctttgagccagctcttcttttcatttaccgcatcctcatattgtttcgtacctaacgcacagcaaatatgattgtcatcaatattgtccctggtcaactcaatgtattccatttttcctcacccgctttcttttggaaacatcagctttacttccgatgaacattgtaatttctcagaaatatagagtcccagtaccaatatatgaacgcagcagcaatgctcattatgtaataaatgaaacttctgaaaaccgtgaaatcaattgacggattacctatgtgccagaacaagaacacagctaaaaaagcgactgcggtataaatgaaaagatgaaccaaactaaactttttaggcttctttcttagccatagttgcacaggaacagcaaacaaaaagtaagtaatgaatgcgtaaaaagcaatgataactacagtaaccaatgcaattggcacaaaacccgagtatacaaacatatatagcccgaaaatcaaaccatacgacaaacttgaaaaagccaatgtgtaggtatagctctttaatcttgttgaattcagcttcaagtcaccgccccgttcatttacttcgcacttacaatatcgtagttttattgtctatttgtctgttttaatcactatttgacattcaattttataatctgtttctcctgtttcaatctttgtatcatcgcggttaactttatatttccctccatacaaacttgctgatatcgggtgccttataccactctttaactgatcgtaaatgtatttcttgccttcttgaaaattctttcgaggaacatgtcctactttgcaatcatttacatagacagctatagcttccggatcgtacttgttgttctcttctaaccgcaattcacaatttgagaaaaggaaattatgataaataaatatcggctcatcaaaagttgattctagaatctctttatttgtcataccatcatatttttcatcgaagaaaaagctgtcttcatcctcagtcttgatggctttcttaatatctttttgatagtgtgatgttcctgcaaccttaaagtctatatactcgaaaaatgcagacttttcttcatatttccttgagaagcctgtctcttgaatcaagattgggaaattttcttttttcgataccatctctgtttcgttattaacgccaacagtgttcatattattatttttattctcattttgttcatttttaactttgttcttgaaaaagttgagtatacccaaatgtacccctccatttgaaataaaagattggtttaatcaaaaaactcatcatcaataaaatcattttctcttgcaagtttattcgaatcctttttaaaaaacctttgcttcaatttttctttaactgttaattttttgtttttgtcctggcatatatgacatatataatctccgttgtttgataaatgaataagtaatttatcgacacctgaccttttgcagatacacatcctgtgctgaccatcactaaacgaaatatgaccgcaagcatttacgcttgcatatattcctgaatgttttttatgcatgtccggttttatgtagtgcgcagccaatcttctgcattttaatgcatattcatgctcttcgccttctaaagcattaaattccttatcagttaaatctaaggagcactttcctgttctaactttataacagtcatgtttacttagcctaaaataaaaagaatgtttcgtaggatttattaactgatccaacctgatccccttctctttaaaagaatgattttatgcaactccttaaaatttgtatttcgttacttttattgtaactttagtatactatgattacttttaattatcagtatacccataaaaaaggtcaaggaaataccttgactgtgtatcgctcaccaatctgcatccggctcatcgtgttcaaatccgtgaaatccacacatctccgcagccggctccttttgtgaccaataagtaatgatttctgtttgcatcaccattcaccttatcagccgcgctcaagttcaaatgatcacccgtgaaattcttttcactaagggtaaaatcatatcctgacggcgtaattctctgcagtgcaagtcaaatatctatagaaagattatgaccgcaaattcaaagcattctgtgcatttggagatgacaaacccccatttaaacacccttcggatgacaaatcatccgtagaatcctccctgcatagctccctcaatttttgtagagacacttgtccgcaaaaatgtaagggttttcaaaagaagagtcgtgtgctaaattgtaagataagtaaaaattttctgcgaatatttgaaaggggtgtatgatttgaaagcagtagtagcaacaaaagacaaaagtatagcgatcgtacaaaaagaattacgtcctttgcggcatggtgaagccaaagttaagatggaatactgcggtgtatgtcatactgacttgcatgttaaaaatgctgatttcggggatgttaccggcgtcactttaggtcatgagggaataggcattgtgactgagattggtgaaggcgtaacaagcctgaaaaagggcgaccgcgtctctattgcctggatgtttgaaagctgcggccgctgcgaatattgcttaacaggccgtgaaaccttgtgccgtgatgtaaaaaatgccggctatacagttgacggcgcaatggctgaagaagcaatcgtagcggtcgattacgcaataaaggtgccggaaaatttggatcctgcagcagcaagcagcattacttgtgcaggtgtaacaacttataaagcggttaaagtcagtgaaattaaaccaggtcaatggatcggtgtatttggagtcggcggtttaggcaacttggctgttcaatatgcaaaaaacgtctttaacgctaaagtgattgctttcgacattagcgatgaaaaattgaattttgctaagagcttaggcgctgatgcggttgtaaacagtttaaacgaagaccccgtcgctaaggcaaaagaagtgactaacgatttagggcttgatgctgtggtcatcacggctgtctctaaaacccctttcaatcaagcgattgatgttgtaaaagcaggagcccgtgtagtcgcagtcggtttaccggtggacaaaatggatttagatattccacgtcttgtgttagatggaattcaggtagtaggttcattagtaggtaccagagaagacctgaaggaagcttttcaatttgctgcggacggtaaagttgtacctaaagtgacaaaacgcccgatcgaagatgtgaatgatatttttgaagaaatggagcaaggtaaagtgaccggccgcatggttatcgattttacttcctaatcattaaggctgccgggaatgatacggcagcctttaatctctattcttgctcagcgccccacccagactgaataagactttgtcatttagttcagaaaagaaactttacagaccattcggcggacatacattttgcaagtactgcctggactaaccctgataccaatataattccaggtcattcattgccgaagcgtagctgttatgaggaaacccaccagaggttcctcataacactaaaaacctactcactgcactttttacagcagaccttatcagagtgtttgcttaacactttgtccattctacccacaggcatcttcttctcactcggaagtgtaagataagctgttatctcatcccctgattttaatgtttttccgcagatagagcattttaactcagtattaaagaaattttttaatcccattcagaagcctccttatttacctttataaagtaatacgttaatgctttataaaagtttcaggttaaagaaatactccttgtccgggaatttactttctttcagttgttacgtacccgcacagggttaacaatcgtcttgttctttaactcacagtgagaagatcgccttgtaaaacattagcgtaaaatcatcttcatgctttgaccagtttactgcagtgcatggattgttaatttgtgacacttatttgtcctctttaaatttttcttcttctctcaacttgaaaaagaaggaattattttataaatattgtaaatttatagctgtatcacattcactattaagaggaggaatacgaatgaaaaagaaaattattgccggcgctcttgcttttgggttaattccgctaatgggggctgcagatgtttctgcaaaatctttgccaaatcaagataaagtcatgaaacctgccggttggtcatgtgacgctccgtatattgcgtgtcagcctttttctggcggtaccggtaagatttcattcaactatcaaggcagctctccaggaaaaatcagagtttttgtagcgaatgacggcagcaaatctttcaaattcaccattaattatcctaatgggaatacactcttatcctctacgacactaaatgcggggaaaacgttcattcaagaattcagcgttaaccaaaaaggagaatacatcctgaaatatgatagcggcaccggtgatagtgtcgatggtttctttagatctgttgagatctaaattccgttaggaaagtcggcagttttgccgactttcttttccaagcattctgcaggaataaacgtaaagtgtcgaataaacatatgacctttttgaaacggaaactttatctgcaccacaaacccgcaagcagcctccttgtatcgtaccttccgtccctttgtgatttgttttgatttgtcgtatactgcgcttgcccgggaaatgatgaatattttcgttaactataatttccctgtacctcttcgtatgtggctctgcatgatgaagtaacgtcatggctcaccactttcatccacagttttattgcatgttgagccatatccctcctctttaaacagcaaaccgtcccatccatttctctctttccattatttcatattcttagaagctcttcattttagacttaatatccattttttcttatttagacttaaatctatgtcgaaatttatcgtccggcatattatgtactatcctaacaacaggaggtggcaataatatggggaactacggtggaaattacggtggaagttctttcgtattgatcgttgtgctgttcattttgttaatcattgtaggtgctgcattccttttctagcacattgacgatttatattcgtctcccaaacattgcatcccttagttcggacagacgccataagaagttttatggcgtttttactttttaaaaaaatctatctaagataaacattttttattttcactctggtaagcgggagagttttctcccctgcctgcgccaatattgccgctatgaagaataaggtgaacaattcaattcggaataaagacttgttcatgaacaaaacccctaaatagttgttaaaaaactaaggcgtttttaattcatcaggattacagaggttgtgaacttaaaaaggatattactcacctttataaaattgtcatcgttagatttagtcactgaatcttttttgtaagggtccgcccacaaaatgcggtgttcacacattaaatcattttcacataaaaaaaccggattcctcttctaaaaggttccggcttttctttttgttcggtatttgtcagttaatatgcaggaaatatctggtgacgtgcacacacccgctattataatatttcaatagagccttctgttccatgaacgcggattcgctgcccatcttttatcaattgggttgcattttcaactccaacaactgcaggtaagccgtattcacgcgcgataaccgctccatgggtcatcagtccgccaacttcagtgaccaggccttttatggacacaaacaatggtgtccagctgggatcagtatagggggtaactaatatatccccatcttccaaatcggcatcttccatgtttaaaataacccgtgccctgccctctatgactcccgaggaaacgggcagcccggcaatcgctccggccgggagattttctcgtttgtactcgcctgtaacgatttcaccgtcagacgtgataacacgcggcggagatagtttttcatatactttgtactcgccttttcgtgtgctgatgatttggtaatccaatttatttgtgcgtacgacttcctgaagttcttcaaaagtgagatagtatatgtcttctttttcatgaataacccccgcttttgcgagttgttcggcttctttcagtaaagcctgcttataaacgaagtagcggctgatcatgccgtattttggatattctctgaatccgctgaagttccggatgatttggatcattcgtttagtttctctggctttttgttcaccgtccggtaattgcttcaatcggtctaataactcttgttctttcttcaacgcctcctgccgcccttgctcaaatttccgctggctggcatttggctcaaagtttttgagattattaagaatcatagggacaagtgcaattggtttttcgctccatcgagttcttgtgatatcaatttctccggcacatcgcattccgtacttgttgagataagcatagatagcgtcatgggtttcccgcccgccttcaaacttcaccagcccatccaaaaagtgatcatcttttacattctctaaataggcaattacttctggataaggacggatcacatcggcgacgtccaatagcgcaagccccatttctgaagtaatattatgaggtacagattgagaaagcgtatctgctgcgtttttttcacctaaccactcgttcattttttcgttaatccatgatgaagcatccattgcagttcgaatcagcaccgaactttttggattaaataaaatattctttaattcctggatatcttccaaaataaaacgaaataaatcagatcctgatttcgtctggatgttttgttttaactcttctatcgatgcctgactgctcttaatcaaatcagaaacaattgcaggatcgttttcagcttgatccggcatatctgcattgcctttgccgggaatcggcgccgttttatcatgtatcggtttaatgaaatcatctcgctctattatggtcataagtgcgtcttttaagagcggatcgtgctgccccataccttttaagaaaacttctctgacattaggggatgccagttgatgtgtgacatcgacaaatagccttccgccggctttacgcatgggtgcagcagtcgtcaacagaaaaaaagacaatccaaggggttttatgggatccgtcatcatttgctgatgaccgacagagatatagacgtgattttcttgatcgttcgcttcaggaacggggtataacgttgtgatcggacgactttggacaatataaaaagtatcgcggtccaaacaccattcgatatcttgcggctggccgaaatgagcttcgatctgtctcccgatacgtgccagctgtaaaatttgttcatcagtcagtgtttgaatcttttgctgatcaagatcgatctcccgtgtttccgttccgccttctcttcgttcatagacagccttttttttggtttctattctcttatcgacgatttgcccgtcctgtactttataacaatcggcagatactaagccggagaccagtgcttcaccaagtccaaaaccggcatcgatggacagcagctttcggtttccggtcatcggatcagcggtaaataaaatccccgaagcctgggggaacaccatcctttggatgataacagataaataaacttggctgtgatcaaacccattttgcatacggtaaatgaccgcgcgatccgtaaatagggacgcccaacatttactgatatgctgcaagatcgcatcgacgccggtaatatttaaataggtgtcttgttgaccggcaaaagaggcatgcggtaaatcctcagctgtcgcactagaacgtacggcataggcatgttcttcgccgaaccgggagagatggcaagcgactgctttgactacatctgaaggaatttctgcttccataatggtttgccggatttttttgctgacttcaccaatttgatcccgattctccgctttcagcatggtcagttgacccaacagcgcttgtaacgtttcgttttgttcaatggcttttcgatatccggcggttgtgacacaaaatccttccggtacttgtattccttgaatttttgataattcccctaaatgtaacccttttcctccaacgagcaaaggctgtgttttttcaatttcgtgaatgccgagaaccaaagaactcattctatatctccccttcaaaaaaatttgacaagagcttttcagcatgatataatcataatataagatggataactatgacttttaacacagaaagcgcgcgtgttctgattatatcaccgtgtctgtttttgtgcaatataaaaagaacctggccaatttggcgaggttctttcttcattttctaaggaaatcctgaagttgagtgatacctgtgaatccattgcagaaaggctatccccacggattcaagaaacaggaaaatctcaataataaaaaacatcccccacgcaatgtgaggggatgttttgtgtgtatacttctcatttcatcgtcatatgagtttagactgatgcagtcacaacttacaagaatgcttatctgtttccttcaatagtgttaacacatttgaagttatattagcgctgccgctgctttgatatccctaaactgtaatcgcttagtgtattgcgcgggagaaagaattgcattccatggtttattaatgccggctttctcatttgttaacagatttataaaaccaaggccattgataatgagtggccgtttattgttcttcctttgacctcctgaaaattaggtttgtctaaagctctttaaagctgtattgatatcttttgtgtgaacgtaaatgttcttatacaactcgaatagtgttttatatttttgaacattttgttcttttggataaaatgcagctgcttcatgaatgaactgctctgcacattcttcaagagagtcaaaccacccgcttccgaaggcagctaacatcgcagcccccatggccggaccttgttcattttctaacttaaccaccctcgtattgaaaatatcagcctgcatttgaagccacgtttcatttttagctcccccgccaatagagacaaccgtatcaactgattttcccgcttcgcggaatagctcaattgattcatataaagagaatgtgatgccttccattatcgccctcaaaaagtgctctcttttatgggctccgtccattccgatcaagcttccccgaatagatgaatcagcatgcggcgttctttcaccgactaagtaaggagtgtacagcagtccatttgctcctatcggaacagattccaccccccgcaataattgttcaaacgattcgttcggcgcaaacgttcttttaaaccagtccaagctgtaccctgcagcgagcgtgacccccatcgtataaaaagaatccttttttccatgattaaaaaagtgcactttccctttaaaatccctttctttgtcttcttcacaggaaagtatgactcctgacgtcccaatgctgcataacgtttttccggaagaaagaataccggctccgacagcaccgcaagcattatctgctcccccagcgtacacttttgttttttcgagcagccctgtcttcgccgcaacgctcggaagcagcgatcctacacagtcatgggattccacaagcggaggacaaatttctgctgaaataccaaattgattgcaaatctcatcgctccactctttgcgggtcatatgtaaaagtaacgttcccgccgcatcggagtattcggtgtgaatggcgccagtcatgcggaatctcacatagtctttcggaagcagaaaaacagcggttttgttaaaaagttcaggctcatgttccttcacccataacattttaggtaatgtaaacccttcaaggacacgattttttgtgatatcaagcagatgattgccaaatgtctcggttatcctgctgcattgaggcgtcgttctggtatcattccaaagaatcgcatgacgcagcacccgccgatcttggtcaagcagtactaatccatgcatttgtcctgaatagctaatcccgtcaatatccccggcttgaacgttggatatcgaaatcaattcagccaacgcttcaattgtttgctgcacccagtcttcaggattttgctcactatatcccgccttctcttggatgagcgggtaacttttggacgtttctgcacaaaccttgccgttttgattgactaaaatggttttaacagcactcgttccaaggtctattccaatgacatacttcattttttcactccttcctctctaaatagatttccgttgaaatgacccgccataacagtaacttcatgacgggcaattccgggaacttggctgcctgcatcttttatgcgggatctggagcttcttttttcatttggttatacctgtaaaatgtattggtttaatatcgcttttagccgttcctgtctccctgattcgtttttaattggctgattgttcagcgcatattgctcaagtgtcttaaaatcagctcttccttctgcaatttcaagaccaatcccttcagtaaagctgcggtaacggtgttgaatcacatcttcaaacacacgatcttcgattaatttgtgggcggctttcaaccctcttgcaaatgtatccatccctgcaacatgggcatatagtaaatcatcaggctcaaaagaagatctcctgacctttgcgtcaaagtttaatcccccgcttccaagaccgccattttgcaggatttcgtacattgctaatgtcgcagaatataaatctgtcggaaattcatctgtgtcccatcctaaaagcggatcaccctgattcgcgtcaacagagccgagaaggccatgcactctcgccatgcgtaattcatgttcgaatgtatgcccggctaatgtggcatgattggcttcgagatttaatttaaaatgattgtctaagccgtattgctttaaaaaggcaatggttgttgctgcgtccgtatcatattgatgggtggtcggctcttttggttttggttcaatcaaaaactgccctgtatacccgatttccttcgcataatccactgccatatgcataaatctggccatattatcaagctcaaattttaaatcggtatttaacaaagtttcgtacccttcacgtccgccccaaaatacatagttctcggcgccaagctcttttgctgtttctaatcctttttttacttgggctgcggcatacgcaaatacatctgcattacaagaagtcgccgcaccatggacgaaacggggattcgtaaacatgtttgcagtattccataataacttaacgccgctggttctcatgtagtcttttatcatgtccacgattatatccagattttgatttgtctcttttaacgtacttccttccggtgcgatatcccggtcatgaaaagcaaaaaatggcgcatccagtttttcaaacagctcaaacgctgcatctaccctcgctctcgccagatccatgcctttatagtgatcccacggtctctgcatcgtagctgcgccaaaaatgtctgtgccgtcagcggtaaatgtatgccaataggcaatagaaaatcgcagatgctctttcatcgtttttccgccaattacttcttgagaattatagtatttaaatgctaaaggattcgtggattctttcccttcgtaaatcactttgtttacgctttcaaaatagttgactgaaccggaatgagagtgagccatgtgtgatttcccccttaaaaataaattctaaacttgatgattcgaatacagatgattttatgtcatgttatatattagtttgttgcctaaacaaactaacttattttcatcttatataacctcatcagtattttcaatattttttttagttttttacgaacacattagatataataaaggttggattcgctatgtactgcgtttcgcacgataacacagaacgttcaacttaatttaaagattatacaaacggagtggatgaagtggatatcgctgatcaagcctttgtcaaaaaagttaaccaaaagttattactaaacgaaatacttaagaattctcctatttcaagagcaaaattatctgaaatgaccggattaaataaatcaactgtttcatcacaggtaaacacattaatgaaagaaaatcttgtatttgaaatcggtcagggacaatcaagcggcggcagaagacctgtcatgcttgtttttaatagaaaagcaggatactccgtaggaatagatgtcggcgtggattatgttaatggcattttaacagatcttgaagggacgatcgtccttgatcaacaccaccatttggaatgcagctctcctgaaataacgaaagatattttaattgagatgattcttcactttattgcaaatatgccgcaatctccgtacgggcttattggtataggcatatgcgttcccgggttaattgataaaaatcaaaaaattgttttcgctccgaactccaactggagagatattgacttaaaatctttcatccaaaagaagttcaatgtgcccgtttttattgaaaatgaggcaaatgccggcgcatatggagaaaaagtatttggtgctgccaaaaatcacgataacatgatttatgcaagtatcggtacagggataggaatcggcgttattataaacaatgatttatacagaggggtaagcggattctctggagaaatgggacatatgacaatagactttaatggtccgaaatgcagctgcggaaaccgaggctgctgggaattgtatgcttccgaaaaggctttattaacatctcttcagacaaaagagaaaaaagtgtccactcaagatatcatagacctcgcccatctgaatgatattggaactttacatgcattacagaattttggattctatttagggataggcctgaccaatattttaaatacatttaatccgcaagccatcattttaagaaacagcatcatcgaatcgcatcctatagttttacattcaattaaaagcgaagtatcgtccagggtttattcccacctagacaatagctatgaattattaccatctatcctaggaaaaaacgcaccggcattgggaatgtcctctattgtgattgatcattttctcgacatggttcataactgaaatgtacaaacttctatgttttacgctcatctttaaagatgggttttttgttttgttattttcatcctgaatgggagcatttctgacgtgtttttccacacgggcattttctaatatgaaaaaggagttccaaaatagaaagctcctttttcatgcggacattcatttttctttataacggaaatatctgaagtcggccggaatatgatttccgctcgtatcttggcattgcatccctacaaaagctcctgtaaagaatcccccgccgcggatgtaatcatctgataatttttttgattccaatgcaatatcgattttgtaccaatcttctttgttaaatgaatagaaataataatatttttcgttttcaatattcacttttaaatagacgtacttgacttcacgaggaatcacaattttattttttaacggttgtgaaaaagagaagttatcacatatcgttaattcaagaatacggccaagttcttcatcatgcgtgacttgaagagccgtccagttctctgtattgtaatagttcaccaaaccagcggcttgctgaaaattttccggataaaacgcaacagccgtttccgcttcaaaatggagactttgccagcgtctggctacaaatgcctgagtaaatgtcgaagttaaggattcatggccgtataatcgtaaatgatttggcgcttgagttaatgaacctaatttctccgtaaaagggattcttaacgtttgaaaattaatatttaatgtcgcatcctcaaattcatcaacttccggatacgtgtcttcaaatatggtttcaggtatagaagacgcatccacctccaagctcccttcttttccgccttctacataaggccagccatctttccaatagagcttttgaatagctgtttctctgcccaaaggacaatatcctcgctgctgaaaaattgaatcatcgtccgggtgaatgggacgtcccgttaaatgagctaaataccactcgcctgtatgtgtgtgaacaatggatgcatgcccgcatttttgcaatgggtttcctggatcatgccatgacgttaagattggattatcgggatgaacttcatatggcccctcgatatttgcagaacgggcaattgtagcagcgtgttcgaaccgcgttcctccttctgcggttaataaataataatagttcccgatatgataaaggtgcggcgcttccgtcagctttctttcagttcctttaaatatcactttcggtttaccgatcagtttttgctccttatcagaatattcctgcatgacaatgcctccaaaggagtgccgatcaatacgctgatcccataacatatttaataaatatttttttccatccgtatcatggaacaaagaagcatcaaaccccgagctgtttaatgtgatcggctccccccaatcaccatcaatcgtgtcacaagtcactaaataattgtggcaatctttccaagcgccatctacgaccttaacatccgtatagatcagccaaaactttccgtcgctgtaacttaaacatggcgcccagaccccgcctgaattaggatttcctttcatgtctaattgcgaaactctctgtaatggatgtgcaactaagtgccaattgactaaatcttttgaatggtgtatctggactcccggaaaccactcaaatgtagatacagcgatataataatcctctcccactctgcaaatactcggatcggggttgaatcctttaagtactggattgataatcttcatgcagaacgcctcctcagctattttctgttgactatcatgttttaagctttgaaatcgtcaatatgatccaaataaactttgtctctattctctaattctcgaaccatgtttttatattttttctcatctaagttatagaaattaatatcaatcatggccagaaccagtaagaacacgggaataatggttgctgtaattaaaattcccgtcaatgcctccggcgtttgcgcctgatttgccacatatccaaactgatctagaaccaaacccggtacaacccctcccaaggccatgccgaatttaaagaaaaatccgataatagcgtatatgagaccgcccattcttttcccggtcttatactctccatattcgattgtttcaggaataagcgcccacatatatcccccggcagtgagacttcctgcagcggccagcaatcgaaaggaaagtatcaggaatacattacttggcggaacaaacagtaaagctaagaggccgatcatattcagtaataatgcatagtttagtaatttcttcttccctaataattgatgaagctttggaataaacggtaaaatgaccaaagcaggcaaacttcccaacaaaccgtaccacttcactaaatccgctctttctaaattatacgttacgtaatagatgccaaccgaattactgattgaattcactccaaaaataataataaaaaaaatacttagtacaactagaggccgattaacacgaaattgctcaaatatatccgataatttaattttttcttcagatttttgaagcgtgacacgctcttttgtgcttttaaaacaaaagattaaaaggcacccgcctataactcccataatacccatggttagctgccagccaagagattcgctgccggacgtatcgcttaaataagcagccagtaagggaacaaaaaatgcaacgacaagtcccccaagattcgcaaataacatacggacagacgttatactaacaacttcttgattatttcgggtcattgcagaggttaacgcgccatatggcacgtttatcattgtgtatgtaagcgataaaccgacataggtgatataggcatatattaatttcccaatatccgaaaaatccggggttgtaaaacagagtattgccagtatgacaaatggaaaagctccgaataaaagatacggtctgaagcgtccaaacctgctatttgttctgtctactatcgttccaataaaaggatcagcgagagcgtcgatgattctaaccactaaaaacatcgtaccggctgttgctgccggtaaaccaaatatatctgtatagaagaacaaaagataagtagacactgttgcataaattaaattacatgcaaaatctccagacgcatatccaactttttcaaccatgctgatcttctttacattttcactgagcatgatttcctccccttttcgatcctttacataaggaacatgatgaatggtataacatttcttcaattttatcggccagtgaggtctttataaaagcgctttcaaaaaatgatagcagtttactttcacagagcactttcatcgtagtgaacaggataaaagcttggctttcgttttatatatacctccaattaaatcgagcctcttatcccccttccatttaagacctttacatgaaggacaattaaagcggtttattagtttgttgatcgaacaaactaacttgatttcatattataaaatcttttctgctttttcaactcttttttcagaaaatttaaaaccgatcaaaggacataccatgttgtaattgccggctccttcgacagacgttaagtaaaaaccctatgtgtcacctgactgatttattaaatgataagcacttccatcatcttttgtttagaaaaacttattaagaaacatgcacttgaaaaaatgcgaatcatatataagtgatatcccgtttaattggttgaggaggatattatgaaacctatgctgccttttgaaaaatattttggtgatttagaactggtttatgcattttatggagctatgcctaccggtgttactgtctcagaaaccggtcgtatattcatttgttttccgaaatggggagacgatgttaaatttacggcagcggaaataattggagataaattgcagccttatcctgattcacaaaccaatttggttaactttgagaatatcaaaatgactttcatcagtgtccaaagtgtagttgctgatggaagaggaacgctttggatactagatacagcggcgcccaatttttctgaaccaattaaaggcggggcaaaattagtcgctgttgatttaaaaaccaatacaatcagaagagtgtatacctttacagaagatgttgtccttccaacaacctacctgaatgatgtccgatttgattttcgtgtcggaactgcaggttatgcctatataacggattcttcttccaaaggaccaggagctattatcgtcgttgatttagaaaccggaaacgcatttagacggttaaatggagcaaatccaacttcaccggattcctcttttataccgaaagtagaaggcaaaattttgatgaatcgtaacaaggatggttcaacttccccatttaggctggcatccgacggtattgcgatctctcccgacggaaaggtattatttttttgtcccctgaccagccgccatttgttctctatctcaacagaagccctgagagatagaaatatatcggacatggatttactttatcatgtggcgtattggggagaaaaaggcgcgtctgatggaatgattacagatgcaaaaggagccgtttatgccggagattacgagaacaatagtattcgaaagatgctgccgaatggcacaatggaaaccatcgcacatgatccgagaattttatggccggatactttttcgattggtccggatggatacttatacgtcatcgtgaaccaattacatcggcaggctagttttcattatggagaagacttacgacagaaaccttatagtttacttcgtatcaaaattgatgaatttcctgctcctgctttttgaaaataaaaatggccggttcaattttagagcataattggcttcatttagcctccatcctaaaccgaataagggattacaataaatacgtgtcctcaattatggagttagattcataacttcattttttttggtcaaggaccaaaatatcgacctcttaaccttttgaccaaaacttaaaaaatcccctgacaccaatagtgccaagggattgagagattaatactgagacatgtattgttcgcgctcccacggatgaacctgtgtgcggaacatatcccattcgatttcttttgcttcaatgaagtgttcgaacaggtgctcgccgagcgctgcaaccatgacttcgtttgatttgaattcgtcgagagcttccgccagtgtcgccggaagatctacgatgccgttttccatgcgctcttctttgctcatgacgtagatgttgcggtcaatcggagccggtgcttcaagtttgtttttgattccgtcaaggcctgctgcaagcaatacgcttaacgccaggtacgggtttgccgccgggtctacgctgcggacttcaacacgcgtgctgatgccgcgggaagccgggatacggatcagcgggcttctgttttgcgcgctccatgccacgtagcaaggtgcttcatagcccggaacaaggcgtttgtaagagttcactgtcgggtttgtgacagccgtaaagcttgtcgcgtgttttacgataccggcaatgaaatgttttgctgtttcactcagctgaagatcagcgtctttatcaaagaatgcgttaacgttatctttaaagagtgataggttgcagtgcataccggaaccgtttacgccgaacagcggttttggcatgaatgtcgcatgcagaccgtgtttgcgggcgatcgttttgacaaccagtttgaaagtttggatgtcgtcacaagaacggatggcaccggcatatttaaaatcgatttcgtgctgaccaggagcaacttcatggtgagatgcttcgatttcaaagcccatttcttcaagctcaagcacgatatcgcggcggcagttttctcccaagtcagtcggagccaggtcgaagtatccgcctttatcgttcaattcaagcgtcggttcgcctttttcatctaatttaaacaggaagaattcaggctcaggtccaagattgaaatcgctgaaaccgagttctttcatttctttcagaatccgtttgaggttgttacgcgggtcaccttcgaacggcgtgccgtccggattgtaaatgtcacagatgaagcgtgctactttacctttttcagccgtccacgggaagattacaaatgtgttcagatcaggatataagtacatatcagactcttcgatacggacgaaaccttcgatggaagaaccgtcgaacatgcatttattatcaagtgctttttcaagctggctcacaggaatttccacgtttttaatcgttccgagaatgtctgtgaattgaaggcggatatactttacgttttcctcgtttactaattttacgatgtcttctcttgtgtactttgccatttcgtaaaactcctcctctaaaaggtaaatgtatatagcaaaacagttgctaacggattaatgaaagaatcgggacatgtcaccttggcggaaagtatttccccgctggaaacggcctgcctgcatcagttcgtttttcagaagctttctgagttcgtcatcagacagattgtgtttcatcggtttggcggttttttcggatttttcttccggttcggcagatgccttatccagaatttgtttgatccccgccatattgacgccttgttcaatcagatttttgatttctaacagtttatctacatcatggaatgaaaataatcgtctatttccttcgcttctcgctggaaatatcaatccattttcctcataatatcgaatttgccgggcagaaagttctgttaactgcatgacaatcccaattggaaataaaggcattgagcggcgaatgttatcactcatctcaatttcctccttttcttatcttagtctcattataggtgatgttatattttgtgtcaacacaatgtaaggaatcttaacatcaaattctttgaaaattgcaaacgccctaaatcagctctttttccattaaagcatttacggcgctgcaaatcgcatttttcacgtgcgcgtaggttaatcctccttggacatacgcgacataaggcggtctgataggtccatctgctgataattcaatgcttgctccctgtacgaaagtgcccgctgccataatgacatcgtcttcatatcccggcatatagctcggataaggcgtcacatgcgcattaatcggtgatgcatattgtatcgcctggcaaaaagcgatcatcttatcagggtcctgaaactcaactgattgaatcagatccgttctcggcgcattccatgcagggtttgacgtaaagccgagcttttcaagaaaacgggcggtaaataccgctcccttcaagctttgcgccactacatgcggagcgagaaagaaaccttgatacatttcctgcagtgaataaagcgaagcaccggcctcacttccgattcccggggaggtcatccggtaagagcaggcctcaatccacttggctttccctacaagatagccgcccgttttagcaaggccgccgcccgggtttttaatcagggagccggccataagatccgctccgacgtggcagggttcccgctcttctgcaaattctccgtagcaattgtccacaaaaacaatgacatcctctttgatttcctttacgaaacgaatcatctcttcaatttcatttattctgaaagatggacgattcgcatatccttttgaacgctggatgccgatcacttttgtattcggccggattgcagcccggactgcttcaaagtccactctgccttctgatgttaaatcgactgcattgtatccgatttgaaattccttaagcgagcctgaatactccccgcctcttactccgacgatttcctcgagtgtatcgtaaggcttgcctgtgatataaagcaattcgtccccgggtctcagcacgccgaagagcgcgattgaaatcgcatgcgtaccggaaatgatttgcggccgcacaagtccctcctctcctccgaacacatcagcatagatcttctccagtgtatcccgtccgatatcatcataaccgtatccggttgaaggcgtaaaatgcgtatcgcttactttatgttttctgtagctttgcaggactctccattcattccgttcactgatttcttctattcttttatgaacggcggagatttccgcttctgtttcttcggcggttttttgtaaaagagcgccgtgggtcagtgtgtcaaacatgttgtgtataccttccttacatgaatttcttcaattctccgagtatgctttgttcttcctgtacataacctgagacttcgtagcgttcattttcttcattaaaataaaggctgtcgatcatggtctctgatttgatgcgtgacatcaatttgccttcggcggcaggcacatgaacttcatacggtgtcatcagctcccggcgcaaataagcttcgatttccgcttttagtttcgcttcatccccggcgattcgggcgctgatcatgatgtggccttctcccgctgtcgggatgaagtcaggaagtgtctcatcacgtttgttataagcggtcagcaccggaatatcatctgcctcaagctcttttaacagtccgaggacagtctgttcatgcccggcataatcttcattggatgaatcaatgacatgaatgatcaagtctgcttccttcacttcctcaagcgttgaacggaaagcggcaatcagcgtcgtcggcagatcctgaatgaagccgaccgtatcagacaaaaggacgctgtagccgcttgggagcgccatctttctcgtcatcggatcaagtgttgcaaacagcagatcttcttcatagctgtctgagcttgttaattgattgaaccacgttgattttcctgcattggtataaccgacgagtgcagcctgaagcacgccgttctttttgcgtctctcccgataacggcttctgtggcggataaccgttgacagctgcacgttaatttcgtgtatgcggtttctaatgtggcgccggtctgtttcaagctttgtctcaccgggccctctcgtcccgattccgccgccttgtcttgagagattgattccttgtccgctcagacgcggcagcgcgtattgaagctgggccaattcgatctgaagctttccttctctcgtcttcgccctttttgcgaatatatccaaaataagctgcgtgcggtcgatgatcttcgcttcaattgcagtggcgagtgatttaagctggctcggtgacagttcatcattaaaaataaccagatccgcttcaagctcttcacacagcgccttcagctcgtctactttccccttgcctatgtatgtagcggcatccgctctgttccgtttttgcgtaatccgggtcagcaccgttccgtcagccgtttttgtcaatgaagcaagctcttccatggaatgttcaaagtgctcatctgtcatgtgcggaagctggcagccgaccaaaatgaccgtttctttttttccttcctgttcgttcaaatggatgttcctttctgtgtcgtattgggcagtagtactatcataccaaacccgcagggcgtataccacacatccggcgggttttaaagagagaaataaaaaagagacccctcaaaccggctgagaggtctattcgtgagctgccgcctcatcttttataagtaaatcctggctcttgatcgtcattaaatcgtttttcaagtattggtctcccattaaaagtctcatggcctgagcgcggatcgatttttcaatcacgtttctgacaaagcgcccgttgctgaatttaatggggcttgtcgtgcttttcactgtcattaagtaatcttttaacttccactcggcttcctggcttaattgatactcccgctctgctatcatgcgctttgcgatgtccatcagctgagtgacagagtaatccggaaaatcgatgctgatagggaagcgcgattgcagaccgggatttaatgacaggaaatgtgtcatttctctcgagtaccctgccaggatcagaataaattcatgctgtttgtcttccatatgtttgacaagcgtatcaatcgcctctttaccgaaatccttttctccgcctcttgcaagtgagtatgcttcatcaatgaataaaatgcccccaagcgattttttaatcagatctctcgttttttgcgccgtgtgtccgatgtattcaccgacgagatcggcacgttccgcttcgatcagatgtcctttggaaagaacgttcatctcgaagaaaagcttgccgatcagtctcgcgacggtggttttcccggtgccggggttccctttgaacatcatatgaagagcttgttttccgactttcagcccttgttcggcccgtttttggttgacgaatatccacgcgtaaatttctttaatgttgcgtttcatttcttccatacccactaatgtgttcatttctttttcaatttctttcagaatgctgtgcttggcttcatttttttgcagggcggcctgatattccgcctcagcttctgcatttgtcagcacttgcttttggccattaagaatgatgttaatttgtccgttatttttataggttacagcgcgctccaacatgctcacctctctgttctctctttatcttactcatgatgaagcggttctgtgacatccgcctatcatcatgaggcccgttttcctctttatctgtcactttttccgttctcttcgggaatgatgttgaatcctgcgctttcccgagaaatatttttcatttcttattgtattcagcaaaaacgggaggacaaaccatttatttttattttccgggaaatgttgggtgtatttctcatttttttcatgaatgacagccgtacaagcaccttttgaatatcatcatatgctgtaatgaggtgatggagaatggttaaaatttttatagaccccggtcatggcggaactgattcaggtgcaaccggaaacggacttcaggaaaaagcggtcacgctggagatcgcactggctttgcgcacgattctgacgaatgagtatgaaggagtttctgtcacgatgagcaggacaagcgataagacggtcagcctgacggaaagaacggatgccgccaacagctggggcgcagattattttttatccattcatattaactcaggaggcggaaccggattcgaaagctatatttaccccggtgtcggagcgccgacctcgacttaccaatcagccgtccacacgcaagtaattcaagcatcgggttttaatgaccgcggaaaaaaaacagccaacttccatgtgctgcgggagacaaggatgccggcgattttgacggagaatggttttgttgatacgtcagctgatgcaaacaaactgaaaacagccagttttattgaaagccttgcaagaggacatgccaagggcttggagcaagctttcggtctaaaaaaaaaggctgacttatataaagtgcaaatcggcgcattcaacgtgaaagcaaatgctgatgcgcttgccgccgatgcggtgtctaaaggttttgacgcgattgtgcttccaaaaggcggcttatttaaagtgcagatcggcgcattctctttcagagattatgctgaagcgttggcagcgcgggccgaaaaagccggatttgatgccttcattgtgcaagactaaatgaaaaaacccctgctctccctttttgggacgaacgggggttttttgttattgaagtatatcggcgacaaaccgagaccaagcttcaagacgatgatacacattttcctctttcagttcgctcagtttcatccagcgcccggcgatttgatctttttctttcacttcgacttgtgctgcaggcgctaactggagcgcagaaaggatgccgatatgcaccttccctacatcgttttcatcatcattgatcaggccgagtgtgacaatgttttgtttgtcctcctcgcgaatgtacaattcttccgccagctcccggtcggtgttctgtttcagcacttccaaaaatgaagccgccccttccatagggttcatgtgtccgccgaagccgagagaaagcttattatggaggcgcgattcccctccgcccgcgagccgttcatacacaaatacctcatcatcgcggcggatgacgacatacggaatcggctgtttaaatcgcgggtcctcttccgcgtcgcctcttctgatttcaaaaaaatgcgcctcaatttgagccataatttttatgatacgttcatcctcgctgttgactccctgaaatgtcagcatttcgttttgaaagacgtcactccgcggtgcagccaagatgatttcatccattttattcatgcccgttcctcctgtcttacctctccactcaagccaaaagagcagatattatatctgctcttcatcttggccaaaataaaaatcttcgtccttaatcggttctaccgtcgcctttttgtagccgttccctttcatggagaagaaatcatgtgattttgttttggtgtttaatccgtttaatacaatcggattaatatcctcttcttcaaagtaaggatcgaaccctaagttcatcaaagctttattggcgttatagcggatgaatttctttacgtcatgagacagcccgacttggtcgtagagatcctctgtatattcaagctcattgtgataaagctcttctaaaagctcaaccgcaaattcgcgaagttccgcttttttcgcttctgtttgtttattgaatatttcctgggccagcagtccgacatatacaccgtggatcgcttcatcacgaagaatcaggttgatgatctcaccgctttgcatcagttttccctgtccgtaaaaatataacggataatagaaaccgctgtaaaaaaggaagctttccagatagacagaagcaaccatcgctttgaacagtgaaatttcatcatctttttgaatggctttgtaaagcccgacaatcatttgcgcttttttctgcagatatttattctgctttacccattcaaatacttcgttgatcgtttcagtcggagcaagcgtcataaaaatatttgaatatgattttgcgtgcaccgcgttttccatcatcgccatgaaattaagaaccgcttttcgctgatggccttcgacgtgctcggccacaatcggcatgcctgtgttcccctgctctgtatcaagcagtgtcaggccggcgagcaccttcatgtacgtatcctgctcatttttacccaaatacttccaagtaagaagatcgccgtttaatgcgatctcttccggaagccaaaactgctttacgttttggttgtagaacatttgggtgaaatcatcttcatgctttgaccagtttgctgcgtcataaatttttgtcactgttaactctcctttaatcaaacgacacaagaaagacagctgtcctgcccggtatctttcgttcttgcatagtaaatggttttgatgcctctatggtgggcatacagatcaatacggttcagatcacgagttgtcatcgtatctttcaaaaacagggtaaagctgattccctgatcgatatgctgctggattgtcgcgatcatatccaccactttgaacatgtccatatcataagcttctttgtagaagaaccagttattagacgctaaccccggcatcgggtaatacgtttttgaatttccgtatgttctttcttcgatccgttccatgatcggcataacggacgccgtgctggattggacgtaggaaatggagcctgtcggcgcgatgcacagtctgtagctgtggtacatgccgttttcggcgacaaacgccttcagctctttccagtcttcgattgtcgggatgtgcatgccttcaaagagcgcagcgattttttcgtatgccggtgagaactctttttcgatgtatttattgaaatattctcccgttgcataagtggagccttcgtaatgctcaaacgtttcgcctttttctttcgcaagctcagctgaacgctggatggaataaaagttcaccatcataaagaacgtattcgcaaaatctcttgcttccgggctttcataagcgatgccgttttgggccaggtagccgtgaaggttcatggcgcctaaaccgatcgacttcatcgctttgttcgcgcgtctgactgccggcgcgttgcggatatccgtcgtctcagatacatgagtcagggaatccgtcgcgagtttcaccgtgcgctcaatcgatttatgtttcatgacattcaaaatatttaatgaaccaaggttgcaggaaatgtccaggccgatttcgtcttcctcgtcataatctgtgtaagccgaaacctgtgacgcctgaagcacttcagagcaaaggttcgagaatttcacttttgatacgtggttattcgcatgctctttgtttacgttgtcctggaacataatgtacggataacctgactcagaacggagaacggcaagcttttcaagcaatttgcgcgcattcactttttcttttttgacacgcgggttgtcaacaagctcctcatacatcgccgtcatgtccatctcatccatatgctggccgtattctttataaatcgtgtgcggatagaatacataagccgctttgtcctcacgtgcaagctcaacgaacttatccggaatgacgacaccgatagaaagcgttttgacgcgcacatcttcatccgcagaaatctttttcgtatcaagaaagtcattgatatcgcggtggaaaatgtttaagtacgccgcgccagagccttgtctttggcccatttggtcagcgtaacggaacgcgttatcaagaagcttcatgacgcctacaacaccttttgtggcgttttcaacatctttaatcgcttcacctttcgcgcggagcttggacaggttaagagaaacaccgccgcccagtttagaaagctgcatggaaatatcgatcgcccgtgaaatatcgtttaaggaatcattgacttcgagcaagaaacagctcaccagttctccgcggcgttttctgccggcattcaaaaatgtcggtgtgctcggctgatattcctgattgatcatcagattcacatattcttttgctttctcagtgtcgccatttgcgaagaacagcgcaacaattgagatccggtcctcataacgctcgaggatttttttcttgtcattcgttttcaaagcatagtcattatagaatttaaacgcactcatgaaggaaggaaaacgaaacttcttagcgtaagctgtcttaaacacttctttaatgtcttcaaaagaataaaggcttaagaattcctcttcgtagtattggttttcaatcaaataatccagcttctcttttaaatcgtgaaagaaaactgtgttttgattgatatagtctacaaaatagctatgtacagcctctttatctttatcaaactggaattttccatcttgttggatcatgatttcgttatttaactggatccattttggcacttgattttgtgacaactctttctacctcctgagtaaacaattcaacgtctttagatgtgccgctgagttcaaatttgtgcaagatcggcacctgatattgtctagagatggtatcggcgctttttgcaaagttatcgccccatactttgttgccgctcgcagcgactcctaataagagatgggcgtatttttcgagaaatgattgtgttgatgccggtacctgaccgaagtttgtcgtgtaggtgaccaaaacaaacggagtgtccacgtggtccatttcgtccaccttgcggatcagctgaaagtctgttttattcacaaaacgctgaacattccctgtctttgaatcaaatatgatttgaaccatccttatcacgacctatcaaaaataatgaatctcttaacactatatatagtatactaacctctcagaaaaacacaacatattgagatcgatttataaaaaattcatatttttgaaagagcggactttggctccggcccgattaacgcccaaaaaagagagcagaacgagaatcatctctcatcctactcaaggtgtcatgtgtaagccgatgtctatcataacatgaaaaaaaactgcttagtagtctagacttttattcttattttttgtaagaatcacattttttttcgctttcaacggtttcttcaatctctacatcagcaccgatttctttcagtacggctttcagagcgcttgtgatggaagcctccctgatcagttctttgccgtcaacgatgatgctggttccatattcatagcaggaatcatcttcacaagtttcttcccaatggttgattatcaccttgtgtttcaatcgtctcaccctctgcatgatcaatgtcagtacttagtgtagcttgtgcggcccgctttgtaaattcgaacgcttgtgaaatttattcaagctcatccagcgccgtttcttttttcagttcgattttattcgttttttcatcatagcggtatatttttagataaccgccctcgacaatgccgaaacgattatgttccagctgcaccatgccttctgtctgcgattcggcatccgccaagccgccgtcatcatccgtcaccaccgtctcgtgattgctgcaagctccaaacagcaaaaaaacagcgatccaaacgagcgtaatcctgattcttctcagttcattttcactttcgaacacgattttccgaacccccttttatctttccgatatacggcctgcaatatacagacgcgcatagaaaaagaccattgttcatggtctttgtcaaaaagtctattcaagctcaagctggacgtttttttgcggggcgaacgtggagatggcatgtttataaataagctgctgcttcccctccgtttcgagcaaaacggtaaagttgtcaaagccttttacctggccgcgaagctgaaagccgttgagtaaaaacaccgtgacgaacgtattgtcttttcggatttgattcaaaaactgatcttgaatattaatcggtttcatgtttcgtcctccttggttctcaatacaatactgtttcgattaaatttccagttttcctgctatgcactcgaaaatttccttttttttctgctcaatatcaacaggcggcgtcatatctgtccatgaaacgggcattttattgcgaaaccaggtcagctggcgtttcgcatatcgccttgaattttgttttaattgctccacggcctgaggaagcggcacttttccatcaagatattcatacagctctttatagccgatcgcctgaatcgattggctgtcccggatattcatatcatacagccgctttacttcgtcaagaaggccggtttccagcatcaggtcaacgcgctcgttaatccggccgtacagtacttctctgtccattgtaagaccgataagaaccgcattgtaaagcagctcccgtttttgggttttaagatgctctgacattgtttttcccgatacatgcaggatttcgagcgcgcggatgactcttcgcgtattgttttgatgaatggctgccgccgcttccgggtcggctgccgcaagcttggcatgaagcgcttccgccccttcttcagccgccagtttctccattcgctcccggaatacagggtcgccggagttttccgtgaacgtatagtcatacagcacggactgaatgtacagacccgtccccccgacaatcatcggcagctttcctctaccggcaatctcggtgatttttcccctcaccattttctgataatccgccgttgaaaaagtgtcggacggctccaaaatatcaatcaggtgatgcggcacgccttctgtctcttcttcggtgactttggccgttccgatgtccatccctttatatacctgcatggaatctccgctgatgatttccgcattcagcattttcgcgagtccgatgcttagttttgtttttccgactgccgtcggtccgacgagtatgacgacaggctgttttttatttttcaatatgtatcactctcttttataaatctccccctaattatagcattcatttcttcaggcacctatccattttgccctttttcctgagcgctaaacgtccgctaccacccgatcggctcgtttccgacaacctctctcgtttttcctttgagcgtatggcggtgcgttttccgtccttcctcccgcggatcgtaaacgacgccgccatgctggatccgaatcggctcattgtaggcggcaaaggtggtctctgaaagctcatggtaatgtgttccgtcaaccctcgggatggcagggccggaaatgccgtaatacctatgaaaatggccgttttcaaacgaggtgatgcccgtatagaaatgtgtatgctcatctgtattgctgccgttctccggctgcgaaaagccttcgatcatatggtagtgcccctgcactacatccgtaacagcccggtatgcgtgtgtgtgcggaggtttttttgaccaatcggactgatacaggcccacaaaagctcactcctttatttttttgataaatgcccaatcaaaaattggtgggctgaatactctgttatcatctcaaatttattcttggaggtacctaaattatgaatgaagaatacacatatgcagcagatagtgatatgagaccgtttggacggcccggatttgggtttggacggccgggcttcgggttcgggcggcccggattcggcttcggcttcgggcggccgggttttggatttggccggccttggtttggttatggattcggacggccgtttggtttttacggcggaccgttcttcggagggcttgtcggggggcttgtcggaagcgctttattcaatccgtacctgtacggaggttacggctacccttactatccgtattactactaagacaatcaaaaagggctcctttcaggggcctttttatataggcctaatgtcttgacttggcgggcaaagttcggatattattttattttactgccttaaacaaaaggcataaggattatgatgagagggggatttgatatgattctgggttatatcttcctcacaattgctattttatcagagtcaatcggcgcggccatgctgaaggtctcccgcggatttacgcggtttttgccgagcgcgcttgtagtggcaggctattcattggccttttatatgctttcacttacactgaatctcattccgctcagcttatcctatgcaacatggagcggagcgggaacggtgctcgcatccattatcggagcgaaatggtttcatgaaaaactggacaagcaggccgtcatcggacttgtattcttattggccggtgtcattctgatgaattggtagaaaggagaagcatgatatgaaaggattactctgcctggcattagccattgtatcagaagtgttcggaagcacgatgctgaagctgtcggacggttttacgcacttatggcccgctctcggcgtcattgccggaatcggagcctcttttatgtttttgagcttctctttgaaaagccttgatttatccgccgcatacgcgacatggtcaggtgtcggcacggctttaacggcaattgtcggcttttttgtttttaaggaagccatgacagctaaaatgatgatcgggcttatttttgtcatcacgggcgtcatcctgctgaaccgttccaagtctcaaaaagctaaaaaaaatcaaacggcccggagctgaccgtttgaactcgtcaagcgcgggcagcttttacttcaacctcaagctccatctccacgtttccttggaccgctcgtgaaatcatacatgaggactccgctttttgcgctaacttcctggcgagcgtaaagtccgtttcggctgcatccggctttaataatataaacgggcggtgaatgattttctggtacgtgaacacaccgttcgtgacgtctacaattccttcagattccatatgtagatcttctttatccaggccgcttctttccatcatcgccgcaagcgttataatataacaggtcgcggccgctccaagcagcatttcatcaggatttgtgccttctccgggtccgtccatttccttaggaatggacacagcggtttccagccggccgcttttaatatcgccgacgtcattgcgatttccgggccaatttgcttttaaataaaagtgatgttttgccaagggacaaacctccttttttttcagtttactcacctttcactggtttgtctttttttaagctcacgaatactcttgattgatcactctttttatcgtacggacaaaccggtaaaattcctccgtttttgtgaattccctttcgcggtaatcaaaattatcaaaaaacgcctcccgctgttctctgctgatctcaagctgtatactcagcccggtttgcgcctggttattgatattttcggtgtcaaccccggccagaccggtttttgaggttgccaattctgtaggaaatccgtttcgtttgagagctctcaccaattttttcgcccgcttccggtcgcttcctccgacaagagtatttttctcgtcgcctttataaccgtgaactgcgataacataatggtgctgcttaatgctttcgactgctgaaggctcatcgaacttggtgctcgtaatatgaagagtctggttatcatgcgcttttaatccctcaaacaggtaggttgaataatcatccctgaaagagcggacgatctcgctcaccccgccctcaattctccctccgtgcggggacatgatcaatacggggctcccctttctcttattgtacgatatatgataatcatcggggtcttcatgttcagccagatctttaaaatctgtgtatgtatcagaagaattcgagggatcagggtctgacgcataatgagcacatcttattagtaagaccattgctacgataatgatgacattaagtaaaattcttttcatcagctctccttctttgctcctttctgaaaaatgaaatattcattatatggatttttgtcaataggtcttatcttaacattctattaacattatcatcagtgaaaaacttcccggtttcgaaaaatcaatggattgtcacggttcaagcgctcaaatgccgggcatcagtgaaaaaaggttgagagagggcaaaaaaaaagggaggaacgcccgaattttcaggggcgggagattcacggccggaaacggacggcatcaagaatacgcttttagaaatgaatatccgcctcccgaagcaaatgcgcaggacagaatggagcccgtcaaaaaagttctcatctgcctttttgtacagcaaaatgccattacagcccgctcatcccctttttttatcataatggtccgttttgaaacggagccgtctctttattcatatatataatatcaatcggaagctgtttttccaaggaatgtctcaatatgatgttcatgtatatactaccttccgccggcttcattacaaaacgaacaaacgttccgtttcaactcgatttcttctcctgaaaaagccgcaagtaaccagcgctcctgaaggacaaacaaactgaccgaacttacggcctgttcatatggtatagagagaatcgccagaatgggaggaaaagtatatatgtttggttactcaatggtacaaatggtgcggtcaaatgctcataagctggactggccgctcagagaaaacgtattacagttatataaacctttcaaatggacaccttgctttttacacaattttttcgaaaaaaaggtgaaaaacagaaagaaaatgtcagtcatcattgaatttgaagagggctgccatgaatccggttttcacagcacaggacaggtcttatcaaaagaaaaacgctgcaccataaaaaagcagtttcaaacaatcaattgctgcagcgccgaagtcacgccgtccgcccttcacatgcttctttcgcaatgccgggatatccgtaaaatctatttaaaccgtgaagtaaaagctctccttgatacagcagctgaatcgtctcatgcaaaagaagtgacccgtaacggcaccgtattaacaggaaaaggcgtaaccgtcgccgttattgataccggaatctatcagcatcctgatttagaaggcaggattatcggctttgcggactttgtcaaccaaaagacagaaccgtatgatgacaacggacacggcacccattgcgccggtgatatcgcaagcagcggcgcttcatcttcgggtaaatatcaggggccggcgccggaagccgatctgatcggagtcaaggttttaaacaaatcaggatcaggaaccttggctgatatcattgaaggtgtggaatggtgcatacaatataataaagaacacacaaagaatccgatcagaatcatcagcatgtcgctgggcggagatgcgctcaaatatgataaagaaacggacgacccgctcgtcaaggccgttgaagaggcatggaatgaaggaatcgtcgtctgcgtcgccgcgggcaactccggtccggaagctcaaacgatttcaagccccggtgtcagcgagaaggtcatcacggtaggcgcctatgatgacaatgatacagccagcaatgaggacgatacggtcgcttctttctcaagccgcggcccgacggtgtacggaaaagagaagcctgacattcttgcgcccggggtcgatatcgtatctcttcgttctccgcgttcatatcttgacaaattacagaaatcaaaccgagtaggctccttgtatttcagtctgtcgggcacgtccatggccactccgatctgtgcgggcatcgctgccttaatccttcagcaaaacccgcagctttcgcctgacgaagtgaaaacattgatcagacaaagtccggatcaatggacaaatgaagatccgaacatttacggagcgggcgcagtgaacgccgaaaacgccgtgccgaaagagtaacctttttatcatgagaacggggtcgtctgcaccggcagatgactccgtttttcaggtgaatagatgaaacatttataatgaaggaactcggaacaggtcagaaccggctgtcagaaaaaaagatcaacgcaaggcagtgtatttctaaaaaaatagggaataagtatggtgtagataaaaggaggaatcacaatggcacttacaaacaccgaattgtctgaatggctgcaaaaacagatcggacaaacgcttgatatcagaaaaggagagctgacagacagccgaaacgagatttctgatatggatcagatcatgcttcaccttgatgacgttctcgtccgccggacaaaccatcccgatgactatgtagcggatgaagaactcgtcttaaaagggcacggcacaacctatacggaggaaggaaatgtcccgcttccccaagatgcgtatgaaattcctctgctcggcgacattaccatccaacaggagcaagacggattaaaggtacatacagatcgggccgtgtatacaatcgggacccggaaagagcaataaaaagaaaaaacgccgtgaaacagcggcgttttttattggtttttttcttcagaatatccgtggaacatcgtgaatgcgcaaagcataatgcctaaaataatgataatcgggagccagatcacggcaaacttataatccggttcggcaaaagcgcctatgaccgccccaaagcaatacagaaccaaggcaagcgcgcgcaatacagcatctctcgtaaactgcttccgcttgtccgctttgtaaaaccttgcggtgagatcttcaaaaaaattagcgagcgttcccgttaatacggtcgtggaaatccccgctacaccaagttttctcgcggctgtcgtctgcattcccattgcgaagctgagcagcataatcagcacataaacagaaatggcgtctgcaaaaaagcaggagaacaaagcaaacagcagcaaaacagctccttcaatagctaaagcggcagttaccgcagggggccagaatgatttctttttattgcccacaagcagggccgcggcaataacgccggcaataaatccgattaacgaggttaacgatttgagtacggcaaggtgccatgagttgccgatcgccaggccgaacagaacgatgttccccgtcatattggcggtaaagatatgtcccaggcttaaataaccgatcacatccacaattcccgctgttaaacaaagaagtaaaagtgcaatatttcggtatgtagtcactgtcaatgtgatccaatcctttctcatgctgattccaacatataagtttactctttgccatttcatatgtccagccggcgtgccgctttttcaaagcataaaaaaactccggcgaaccggagaagttactgaacgataaataatactctcgtgccgtcggaatagccgctcatttgatttccaacccatgaaccggccccgcggttatccgatggggttacatatctgatatcagcccccgccccgccttctgtgcagactgccatgggccattcatcacggtcaaacccgggctttgtcggaattcctttcaatgattctttccttctgttctccgctccgccccgatcaattgtacaaatctcagaatgacctgccgaaatggcgtcttttatatgatttcccgtctccggatattttgacagcgggaaatacagcacctgatcgtatcgggatgcagcatgagcagcactgtccgaatggatgccggcgcccgtaaggccgaactgaagagagatcaccaaaagcagacttgccgcccatttcataaacgcattcattcacatcctccttaagaagttgatatgaagcgtaaatatgtatattagccggatttaacacacatgatgaaatggcaaaaaaagtttgctgttttgttgataatcaacgaaaatggcggctttacgatttgtctattgaaccggcttctttttccttatatattttagacatacttatgagccgttgtgatcagtgtcttcggcagataaaaggaggaatgccgtccggtcggcaggcaccggctgttggttatgtcttttcaaaaacatgaaggcggggaaatccagatggaaaaaacaatgtttcacccacactcacccgagtttcacgaagacccttttgcggttttaagcagattcagagagcaggaccccatacataaattcgaactgcagcgtttcggaggcacctttccggcatggctcatcacgcgttatgatgattgtatggcgtttttaaaagacggcagaattacgagagatgtaaaacgggttatgccgaaggagctgatcgcgaagctgaatgtcagcgaagatatcgattttgtctcagagcatatgctggcaaaagaccctccggatcattcacgtcttcgatctttggtgcatcaggggttcactccccggatgattgagcagcttcgcaccgggatagagcagatcacagaagagctgctggatgaaatggaaacaaaagcagaccctgatatcatgaaagatttcgcggcaccgcttccgtttatcgtcatttccgagctgctcggaattccgaaagaggaccgcgccaaatttcaagtatggacaaacgcgatggtcgacacgtcagagagcggacaagatgcgaccaaccaggctctcaaagaatttaaacaatatatgaaaacactgatcgaagaaaaaagaaaacatcccgctgaagatctgacaagcaagcttatttacgctgaagaggacggccaaaagctgagtgaatcagagctgtattccatgctgtttttgttagtcgttgccgggcttgaaacaacggttaaccttctcggctccggcaccctggcgcttcttctgcacaaagaccagatggagaagataaagcgacagcccgaaaatatccagacggcggtcgaagagcttttgcgttacacctctcccgtcatcatgatggcgaatcgatgggcgattgaagatttcacctataaagatgtttctattaaaaaaggcgatatgatatttatcggcatcggttcagccaatcgggacccggaatatttcgatgatcctgatacattaaatatagcgagaacaccgaaccgtcatatctcttttggattcggcattcatttttgtctcggggctccgctcgcccggatggaagcatccattgcctttacttcgcttttaaaacggtttccgaatatagagctgaaaggcgcgcacgaggatgtaaagtggagaaaaaacgtgtttttgagagggcttgaaacattgcctgtcagattttaatatcgccccctgtttatcgggggttttttaatgtcttataaacaggaaatcaatataacagtgaatatttagtacatagtgtatttagttctattgtaaaaaaagcggccggattgctccggccgttctctattaccgttttaccaactcatttgtttcgtccagcttttttttgaaagatttaaggaaatttgcgcttatcgttcctttgtttgcgtacagtttttcgcagaatgccttaatggcgttttgcggctttggttccgacagcattgtgacatgattggaagagtggacgtccagcaggtgaaagtgtttcatctggtgttcccattctttccaatacgcatcatggtctaacggaatttgttcttcctctgctgtcagataacgttcaaaatctccgagaaacaaaccgcttttattacggaagtagtagcattgcagcgcttccggatgaggcagcggcttcatgtcatactcttccattccgtaagcgagctgcgtcttcatcatttgctccagctgcatccggatcgcttcttcggattttggcagaccgcgctttttggcaaggccgatcaattctttcaatacttcttcttcctcagcctggacggtaatgtcttctctgctgattaatgcctcttcaaggttttcaggcttaagatatgccgtaagcatcgtattgatcgtttgcagcatgactgacttaacagatggttttctctctttccatttttcactgtacggggtgtcgatcatgacggcgctttttactgtatgaccttcctcctgcaagaggcgcgcggtttcataagcaagcatcccgcccaaggaatatccgccgaggtcataagggcctttcggctgtaccgcttggatgattctcatataagaagcggccgtctcttcgattccttgcagcggctctttccctgtcaaacctcttgcctggatgccgtaaaaaggacgctgactctttttggcgaatggctggtatgcttcaacgcctcctgttccgccgtgaaaccaaaaaacaggacggcctttttctctttcattcagcttgacgagttcgggaaaattccggcccgcttcatgcggctggttcgtttttaacagcatgccgatctcctgaagagtgctgcatttctgaagagcttccagactgatgcggctgtctccgtcctcaagttttttcagcagctgaatagaggagattgaatcaaagccgtattcagtcagcggcttattttgatcaatttccgctgccttcatccccaaaatgtcagccacaatgtcagctgcgctctcgcggcggagctgagggtcctgggaaaccggcgcaagggtgatgtcttctggctgaccgccattccaatacttgtggtgttcaaaaggatatgtcggaagcggcactctttgaacagatttgccttggtggagtctgtcccacggtatatccgctcctttcacccagcaaaatgcaagcttttccagattgttttcagccaacagcgtctccgtgacgactgtaccgagagtcccttccagtaaaacgccgatatctcctgatccagtctgctgactgcctgtaaagaagcttttcattccattgctttcttcggaaaatgctctgtactctttcagtttttccagcaattcatcttgattgcgggcaacgagtgccaagcggcagttcatcgcctcacggccggtctgaagcgtataagcaatatcccgcagtgacggagtatctccagtttgcacaaaatcagccagctgacctgcggccgccttaagacgcccttcgctcttagcagaaagcacgataagctgcgggtcatgcgcagattctttgtctttatggctcggactgtactgttccaagacgacatgcgcattcatgccgccgaagccatagctgttaattgcggcccggcgcgggatcggtctgcccgtatggtcggtgagctgtgaccattcctgattgtcttcggtgaaacggaagcggcttttctgaataaccatttgctcatttgcagctgtaaatccgggaatgcccgggatggtatgatgcttcatggccatcgctacttttataagggcggccagtccggaagcgagttcgccgtgcccgatgcaaggtttcacggtgctgatataacaaggcgcgctttcctcttgatttgcagactcgccgtaacccgctttgattgcattaaactccagcgcatctgccatttcggaggcaatgccgtgcgcttcaatataagtgacggtttgcggatcaacatcggtgtcttcgtacgcttttttcatcgcggccttcattcccgccggattcggtgcgtgaagcgacatgcctttaccgccgtgagacactcctgttcctttaatgaccatgtgaatatgatcgccgtcttcaattgccgcctcaagcggtttgatgatgataacgcccgccccttcgcttctgacaaagccatcggcatctttttggaacgatttcgcccggccgtttttgcttaaatatcccatcgagtcaaaaccgataaaacctttcggcgattgcagaatattggcggcgcccacgacagcctgctcacattcgttatgatggattgattgaaccgccctgtgcaatgccaccagcgttgacgtgcaggcagcctcgtaatattcactcggtccttgtaaattcaaggcatatgatatcctgttcggaatgatggacggaatggctgttccattgttcggatcgctgttgcccgcggcaacgaaaacgcctgtcggtctgcttgataatgccttatttgtcaggcccgcatcctccattgccttccatgtatgcatcaaaagcagaaactgctccggccccatttgtgatgcctctttaggagaaattccgaaaaagagcgggtcaaattcgccgacaccgtcaataaaaccgccccatctgagactcgtgtcattctcatcgccggcgtaacggcgccagtcccagcggtccgccggaatttcggtaatacagtgatccccgtttacgatgtgtccccaaaaagactggatatccggggattgcggaaactgagctgacataccgataatcgcgattccttgcttgacatcggcgttttcacaaggcgtatgctgtttcttcggtaaagtgcgctcttctgtttccgtgaccccggcctcttctgaatgcctatgatcggcaagcaattgagaaaacttgctctcatatgctgacgcgaagtggcgggtcagctcctccgccgtcggatactcgaaaaacaatgttggattcacatcgatgtccgcctcttggccgatctcttttgtcagcccgatcagactcgctgaatcaagtcccaattccatgatattcgcgtcagaacgaagagatgacgcgggttcatccatcatcttggcgagcttgccaaggacgtagctgcggatatcatctgtcagactgccggcagaaatcggtgctcccgcattcttaacagccgttcgggccggctgattcatctgttcggttttcgggcggaaccgtttcagggcatagccttcaaaacgcatcaccacttccgatcggctgctgatgacatctgcgttaatcagaatcatttcccccgtttgtttagccagcttgatgtgcagccagcaatcggtaagattttccgggctgctgaaggtgacggaattaatgccgaacggcagatagctttccgtctctgtttggtccaataaagaaagcgaggccaagtaagcactgttggcgattaatggatttatggcataatgatgcgcttgttgtgagtcgctattgttcaggttcactttcgctaaaacggcatcagtgcctttgtacagacgggtgatcgttttaaattcttctccccacacgacggttcccgttccatctccgtataactcatctatccggcccacttcccggtaagagcgctgaatggccgccagatctgcgtgctgcttttgaaacggatacgggctgcactcggcatacgccgctatgctccaatcaggagacgtgcggctgcggtgcattatgctcagttcaaatccatccccgttttgtttcgattctgttttcagctcgatgtgatcgcctttttttacggtaatggggctgacgtaattcagttttttaatatgtcctccttccgcttcaggaaaaaggtcacaaaaatgatcgactgccagactgttatatgtagcgccgacgagtaccggttctccgccgaattgatgccctttcacgtatgggtcgtcatcactgtataccgcctgaacgccggcagcgttttctgattcaccgaaatgaaaagaagtcccgtggtcaaaagcgtaggccggcagatgaacggcgtgctcttgctgcaactgatcaaacgtgatattctctcctttttcccattgccgcgcacgccggccgatatcagaatcggagaaattgagattccgctgatccatgcggtaagcggccagtttttccagcagttcctgaacggaagcagccgtaaatgccgcccgatactccggatgatgcgttcttttttgcagcgcagatgcgatggcggccggatgaagagatggcgtcttttctaaaaaggccgccagtctctcaagataggcttcaaaactccattttgttttcgctgacacagggaaaatatattcctcatcgccgtgacgggcctgatcggaattcgggctgatatattcttctacgatgagatttgcatatgccccgcctgccccgaaggaattgatcatgcttctccgcggtacgatgtctcccgtctcggcatccttcagacgctcccaatactcggttttctcctgcaggtaaaaggccgtttgttcaagcgcgatattcggattttgcggttttgcgttaatggtcggaactaatgtttcccgctccatttgcagcagcactttcgcgagctgggacatcccggaggccgcctctaaatggccgagatttgacttgacggatccaagcgcgcaaaatcgttttttatcggtatattgcgagaacgcgttcgtcagggcaatgacctcaatcggatctcccaatacagagccgtttgccgctgattcaacataactgattgtttccggattgattccggctttgtcaatggaagccgccatgagcttcgcctgctgtttcggatccggagccgtgtacatctgccttccgccgctatggcacaacgcgctgcttttaatgaccccgtaaatatggtctttgtcggcaaccgctttggagagcggcttcaagagcaccgcaccgactccttctcccggcatcagccccgtgccggttccgaagcttttgctttcacttccctgttcaagcaaattcgcccgttcgagcgcatcatatttagacggttcaagcgtgagattgacccccccggcaatcgccatggaacagctgttaagcttcaggctttcacaggcgagatgaatggcgctcagtgagctggagcatgcggtcgtaacgcccatgctcgggcccgttaaattgaaaaagtgggaaatgcggttggcgatatgccaatcccctccgttagagctgagcgcagctttttccaatgacgggatattccagaaatattgattgtacatactgcccataaatacaccgattccgctgtctgattcctgccattcgtttactctctctaacgagtagccgccgttttcaaatgtttcccatacggtttcaaggcttagacggagctcaggtgtcatctccatcacatggtcttcccggatgtcaaacaagtgatggtcaaaagcgtcaatatgctgcagaaatccgccgtaccgtgttttgcgttcttcttttcgtgtttcttttgccatcgttttcagaagaccggacttccatctgttttccggagcttccgtaatacagctgtctccggcttttaaatgctcccacagctcatcgagggtttcagactcgggatagcggccgctgatgccgataatggcaatgtcgtcacgatctgagcgattatcggtgacggtttctgtttccggctttggcgcttttggctctttttgttcagtgataaatcgccgcgtttccgtgacaagcggcaccggttcattcattgcaggttccggatgctccgtttcaggaggcgcttgatcggctccgaatgcctgttgcagcttatccgggtaagtttccagcaaatactcggcaagttctttcgtattcgtgtgttcaaataagaccgttttcggcagctcgcccgtcaatgtttccagttcacggataaaattcacctgcaaaatggagtcgatgccgtatttttcaaagctggtttccggctgaatgcgctcgggagcaagctttatggacttggctaacgtttcttttatgaattgcaccgtccggtctgtgactgagaaagacggttctgtgaaatcagccggctctttggaagccgcaatttcttcaaccgccggcgcgtccggctgcttttgcctgatgacgccgtcgctttctgctgccacgatctgctggccgaggtgatgtgacgattccgccataaatgtaacgtaccgatatccctcgctttccagcgcagactgccacgcttcaggatacagcccagggcatccgggaatacgcagtttggcgtcttcatacagccaccagccttccaaaagaccgaatgtcagatgagaataaaccgaatggctgctgatctcatttaatagcaaaatcccattctttttaagcaccgctttggcattgcgaagtgtccgccgaatattttttgtcgcgtgaagcacatttgccgcaattaccgcgtcatatgcacccgcctctataccctgcaaagccgggggctcttccacattaaaccgcttataagtcaaatacggattgtcgggaccgtattctttttcagcatgcatgaaaaaggcctttgacagatcggtgtagcaatattctttcacatgatgtttgacctcttttaatcttttgaaaacggccgcgctcgtcccgcccgtccccgctccgatctctaatatccggatttccgcgttcgggtcttctttcaggcgttcttcaatgaaagccgtcaatgtgtcagcgagcacctcattaaagtagtctgccgtttcattgtttttatagattccttcaaccaattccattgaggaatcaggaaacagaacatcagtggcagaaactctgccggataaaatatccggcaaagctctgagagcggtctccactaaggtgatcatcgcccgtttgctgctgtccttgagtaaaggagctttcttttcatcccattcttgccacagaacgtccgcacgctctatcggacccgttaacacatacgtactgccagactgtttcaaaaagcctttttgcaccaagatggagatgctttcttccagccacctgccgtaaaacccctgcataacaggctgcgtttcgttttccgtaaaaaatccgacagatttcagctggcctgccaatagtttgtaaagaagatcttcagtgttttgcaaagccgtcccctccttaactcaattgttgtacatgtcttgttactttaggctgatagcttcgcagtttttgcatcgccgagccgtgatgttcagggtatacttctatcatttcttccggtttttcctccggctcttccgcctgtttcatcatgacgaactgattcaatgggccgccgagcaatcgttcaagcgccgccattgcttccggcgcttcaattgatccgactcccgcctgtttcatccgttcttgatattcggcagatgatacgattccgacactgccccagtagctccaattcatcactgccgccgaatacggccgaacttgagccaaatgagcggcaaaggcatctttgaaactgcacccggcagcataattgctttgtccggccgctcgcgcaaatgattgaacggatgagaagaacaaagcaaagtccagcggctcattttggaacacgagggccatattcacgctgacattgacttttgcagcgagcacgcttctcaaacggctttccggcatattcgccaggctctgatcctctaaaacaattgcggaatggatgattccgttaatttgcgggtgcgtgcgtttgatcgtttcatacgcccgtgtgagctcatccgggtttgccgcgtcagcttcaatataaatcggcgccggcccgaattggctgagtctgtcgattttttcctggatggcgctgttatgttttcgtctgccgatccaaacgactcgcgcctgatacgttttcacggcatattcgctccatgcttcgccgatgccccccgcgccgccaatgacgacataaacgccgcctttttggtaagcgggccggcttgacaccggctgctgtacagggatgaggcgctgtttgtaccagtgattgttgcggtacgcccatgtattgccttgctcatcaaacggcgctgagaacagctccgcctttgaaacatcttccggacatccggcatcaatcagccgtgtttgccagttcggatactcttttgcgagcgaaccgatcaaaccgtgaatgcctgcatgagccggatcaatgatgtccgccggctgtacggactgtgtttttattgtgactgcagtcaagctgattcgcttgcttccgtatcctaaagcaagcatcgctttaatcactctgtacatctggatgacgcccgcatcttgagctttcaccatgtcaccatcgctgtgaaaaggagcgatccatacgatatgcccgaaagaccctcttgctttcagttcagccgcaacagcctctatttcatcctccgggttgatatgaagccgtttcgcagaaggatgatgcaattgaaaagcctcgctttcctcatcccctgcgataaagacaacctcttccgtcttatatgccgggctttggtcacggaattccgcaagatcccataccggagccagaaggtttgctccatttaatgatgtttccggcgccggtccttccatcattctggaagaaatccctttaatcctgacacagacgcggcctgtctcatcgcataagtcaatgtccagccgctgtattttttcatccgttccccgggagctgacatacgcccacatgctggtcgtgcacgggctgaaaatgtccagttcctcaagggcgaacggcagtgacagctggttatcatctgcatgcagcttcagtccgattgtcgcttgcagagctgaatcaagcatacacgggtgaagaacgtattgatctgctgtttcttcgaggaaggaaggcagacggagctcagctaatgcttgattgcttccgatatgaatgtgctgaattccttgttgtccgggaccgtagtcaatgccgattttgttgaataagccgtaacactgttcagaagtcagcatgctgaggccgcattgagctttcagtgcgcctatatcacggtgcggagcctccccggcgccgagaatgccggcagccccctgacagtgtatctgcctgccgcttgcttctgtttgtgaatccgtgtaaatgtcatacacgatttcaccgtttcccctcgggttcaggctgatttgcgcttcaatcgggcggttttccgcttcgatcggccgaacccaaacgatgtttttcagacggatgacagacggaacttccttttgccctttgactgcctgagcaaccgccgccctggccatttccaagtaggcgacgcccggcatgaccggcttgcctttaataagatgatcggtgaaaatcgtctcttgtcccgtaaattcggatcggtaccgctgctctgttaaatccgatacattctcgtgtagcagcgggtgcagcacccgcgccgtcggcacagcttgcggtttttctgctttcggccggttgtccgtgatccagtaccgctctttcgcaaacgggtaagcaggaagactcatccgttggggcttgatatcagaatataagccgtcccatttgatatccgcgccctgcacccataattccgcaagcttgtcattctcccggcggcttatcagctcttcgatatccgcttcgccgtttgcgcctgccataatggatttcagcgggattttacccgcttttcctttataaatgcccgctttgtcataacgtcctttcgcacagctctttagcttgtcccgcagttcttcggccgaggaagcgataatggccgctctttcttccatcgcatcacgcccctgctgaagcgtgtaagcaacatcggcaagatccgcatccgtaaaagaagcttgcgccagctgctgcgcctgttcctgcagacgttcttcttctttggccgacagcacaaagatttgagggtgtgtgaaaacagctgtttttctttcttccttcgggatatattcttcaatgacgacatgggcgtttacgccgccgatgccgaaagaactgattcccgcacggcgcggcagatgattgccgttttcgtctttcaatgctgtccattctcttttttcctgtacgatgtaaaacggactgtctttcagtttgatatacgggttgatgacctcgctgtggaggctttttgcaagtgttttatgcttcatctgcatcagcactttgatcacacccgcgacaccggctgccagtgacaggtggccgatattggtttttgccgatcccaaaccgcagtgactcgcgtaaacggcgggatcgcctgttttttcgtacagcttttgaaaggcggatttcaggccgttgatttcgaccggatcgccaagctccgttccggttccgtgcgcttctatataagtgacggttctcggatcaatgcccgctttgtcataagccgttctgacgacttccgcctgggctttcggattcggtgtcgtcaaggagttcgcacgtccgccgtggttgaccgcgctgcctttaatgacgccgtaaatatgatcgcctgatttttccgcttctgacagctttttcaaaaacagaattccggcaccttcactgacggcaaatccgtccgccctgtcggagaacgttttgcatttcccttctttgctcagcgcacccgctttatcataagcgatgtggccttgcggtgtgacgacggtattcacgccgccggcgatcgccatctcgcagttcccgttttcaatggcgcatacggcgtgatgaatcgcgaccagcgagctggaacaagccgtgtcgatcggttcactcggcccgtgcagattgagcatatagctgacgcggttcggccctgctgacggactcatatttgcggctgacgcaccgccgatatccaggtcggaaaacagtgagccgtacccggtatttcccgtgccgatatacaggcctgttttcgtgccggaaaggcttttagtggaatatcccgcatcttctatcgccttccacgcatacatcattaacaagcgctgctggggatccatctgttcggcttccagcggtgaaattccgaagaacagcggatcaaattccgcaactccgtcaataaatccgccccactttacatttgttttgttggcttcgttaagcgggtcaccgtaatactcctgccagtcccagcgatccgccggcacctctgttatacaatcttttccctcttctaaattgcgccaatactcatcaatatttgcggccttcggaaacactccgctcatgccgacaatggcgatcggttccggtttatgttcagccgcagtctgaacatgctgtacggctgtttttgcaaatcgtttgttccctgccagtctgatgccgccatcatctgttacaccgcttttcttttcttctttcggctgtgtgctgccggcaaattgcgtttgatagtcttctgctaaatgatgcgccaaggcttgaatcgtcgcatattcaaaaaatacggtcggtgtcagatcaagctgataagtgtcattcagcttgttggcgaattccgtcagcgtaatggaatcaaatccgtattgattgaactccaattcgatatcgatttcttcaatgtttattttcagaagcccggaaacttcttttgccagcaattcctgaagtttggccgtcaggtctttcggcgcaggtgtttcttccgttttcttaatcggtgcaaaagcggatgcgggagtcttttgaagcagtttttcccgcattacggcgcggtttccttctataacgagcacgcttgttttccccgtgctccatgctttgtaaagagcttctattccggtttcagtgcgcatcggcgttacaccggttcttttttcggtgagcttcgccatttcttcattgacttgcattccgccgtctttccaaagcggccaattgattgacaatgtgtgaccgtggcggtacattgccgtaaccagcgcgttgcggtatgccgcatagctgtccataaatgcgtttgccgccgcataatccgcctgtcccgcattcccggtgacaccggaaatggatgagaaaacgatgaaaaagtccagcgctaaatgctcggttgcttcatcaaggttgacaaatccgtccgttttaggagccaatacactgtaaaactcttcggttgttttctttacgatatattgatctttcatcacacccgcgctatgaatgatgccgtgaaggccgccatattccgtttcaattgttttgaccaggtctgccgcagttagagcgtttgttacgtcagcctgtttgtattccgcttttgctccgagtgattcaagcgatttcagctgcatccgctgattctcgcttaatgcggaacggcctgtcaaaaccagcgtcggctctttgactttccgggcgatttctttcgcgaaaataaagccgaggcccccggctcctccggtaatgagataaatccctccgtcgttccacggaatgcgtattttgccgccggacacggccgtttctttgacatctgcgctgtatcggatgccgtttttatatttgatatggctgtcatcagcccttgttttattttctctgatgatgtctgtgattctgccgttttccgctggttctatttcaatcagctgggttttcagttttttatgttccaggccggctgtttttagcagagctgaaatccctgagagcagctgatgcttatctgttttagagagaaccgtctggataaggacgtctccttccgtctcttccttcagcagtttttgcagcgtctccaatatccgtcctgtataatcacggaagcgcgccgccgctttcccgtgcagggaggtcatttcaatacattcagctcccgcggcttcaaccgcttgttttagtccggcgtctgtgtcacaaagcattacgatatgccgggcaaaaaccggttccgtttgagcagcagtttcatcgcttcgtgtccataccggctcaagcatgagcgtttccggagctttttcttttttctcaggttctttttcagccgttctgaatgacaaacctttcagccttacgcaaaccttgccattttcatcacaaatatcaagatcgcgtttttcaacatgtccggctttgtggtcttcagaaagtctggcgtaaacccacatctcggcagcgcatgcgctgaatacttcaagctcctgaaccgcaaacggaagcatcagttgttcatcatttgttccggttaatatgcttgatgcctgcaatgcagagtccattaagcccggatgcatgacatactcctgtaccgtgtccgcacaagccgcatcaagagacagtctgcccaatacgaaatcatcacctgtataaatcgctttgacaccccggaaagccgggccgtaatcaaaaccgattttgcggtacatatcgtacacttcatctgcagaaaacggtgtctcggcggattgtgatctcagtttttggagatcaatgaccggagcctttgcgtcagggcggactgatactgccccttggctgtaaacggacggctgatctgtttcccggccgcagtaaatgtcgaattgaacgtcatttgccgtttcgggaatgagacggatgttgacatgaaccggctcgtcttcaatggtaatcggccgcacccaaaccgtattcttaagctggacgcttccttgtccggccggaacttcagatgcctgttccattgctgcgcgcgccatttcaagatgtgccacacccggtaaaatcggcacgccttttacaacatgatccgcaaggtaaaattcttctcctgtatagattgagctgaaccgctgttctgcaaggtttgaagtatttctgtgcagaagcggatgaagcgcgtcttgttttccggcagatacagtgcttgttttttcgtgttttccggtgtgtttcgccgcccaatagcggtcttttgcaaaaggatacgacggcaggctcatgcgtttaggcggccggtctccatacagcttcgcccaatcgacgttcagccctttgacccataattcaagcagcttcgcgtatttgccgcgtgccatccatttttcaacggcttcttgaatttcttcatcttccgtcagcatttgcagcgtgcctttgtctattcttcctctgtacaaatccgcatgcttatctccagtgataaactgtgacagtttttcctgcagttcttctgcggatccggcaataaccgccaggcgttcttccatggcgtcccttccgatttggagagtatatgccatagaaacgaggctggaatgatcgtaccgtttttcagtaagcgcacgtttcagctgttttgcctgctctttcaggcgtttttcatttttggcggacagaacgaaaagacatgggtcgatatgagaatcatctgcttcctctctgtcttctggaatgtattcttcgatgacgacgtgggcatttacgcctccgatgccgaatgagctgatgcccgcgcggcgcggctgttcgtttccgcgttcgtccgtctgcgtcttccattccatcgtctcccgcaccagataaaacgggctgtcttcaagctgaatatacggatttaccgtctcacagtggagacttttgactaatgtgcgatgcttcatctgcagcaaaattttaataatgcccgctgctcccgcggcaagggataaatggccgatattcgttttgaccgaccctaagccgcaatagccggccgctttctcttttccgtctgcaaacgagctgaacgcttgtttcaggccgttaatttcaacgggatcccccaattctgttccggtgccgtgcgcttcgatataagagactgttttcggatcaatgcccgcttttttatatgcggctttaataacttccgcctgttgtttcgggttaggcgttgttaaagatgccgcacggccgccgtgattcaccgcgcttcctttaatgacgccgtaaatatggtccccatccgcctcagcggctttcagctttttgaggaaaaagagcccggctccttcaccatgggcaaaaccgtcagcctgatcggagaacgtcttgcatcttccttctttactcagcgcgcccgctttgtcaaagctgatatacacatccggaagaacaatcgtattgattcctcccgccaaagccatgtcgcacgtcccttcttcaattgaagaaacggcatggtgtatggcaacgagtgagcttgagcaggcggtatcaatcggctcgctcggcccgtgcagattgagcgtatagctgacacggttcggtccgacagacggacttgtattcgccgcggatgacccttcaatcgccgcatcggcattggctaaaagagaaccgtagccggtgtttccggtcccgataaacacacctgtctttgtgcctgagagactctttgacgcatatccggcatcttcaatcgctttccacgcatacgtcagcaagaggcgctgctgagggtccatttgctccgcttcccgcggtgaaatcccgaaaaacaacggatcaaattcagcaattccgtcaataaacccgccttggttgacgtttgttttattggcttcttttgcgggatccccgtaatagtcccgccagtcccagcggtctttcggaatctcggtcatgcagtctttgccttctttcaggttctgccagaaagcttcaatgtcttctgccatcgggaaaatcccgctgatgcctacgattgcgatcggttccggcccttggtcccgctgcactgtctgcggaagtgtctcaggcagagtgcggcgtcgcttaacggccgggcgcgtaatttgagtctcttttaccggtcttgccgattgaatcgtttttgtatttaccgcaaaccgtccggcaaattcctcttcgtattcactgattaaatgaacggcaaattcatggattgtcggatgatcaaagaaaatcgtcggcgttaacgtaagccggtacgttttgtttaactggttcgtaaactcagtcatcgagatagaatccagcccgtattttgtcatttcttcatgaggatcaattttgtcaatgtttacttttaacagcgaggccgtctgctgttttaacagatgcttcactttttcaagcaggctgtcagcatcaatgtcatgacgtacgccgatctctgcttccggatgatcattctctttgcggaaccgttttgctttcatgtgtttcacatctccttcaaaaaccgtcatccgggctgtcccgctcatcaagccttgatataaagccttgatgccggcatctgtgctgagcggtgcgattcccgcctgctgcatcagcatatcttccgtctgctttcctgcctgcattccgccttctttccataacggccagctgacagaaagcgtctttccgtatctttgtcctgcggcttgtaaagaacggcggtactcggcatacatctccataaaaacatttgcagacgcataatcagcctggccgacgcttccaagcacacctgataaggatgagaagacaataaagacatctaatttctcatgttgtgacgcttcatcaagatacacaaggcccttcactttcggagcgagaacgtgttggaattcctctgccgtcttcttcaccatgtagttgtcttttataatgccggcactgtgaacaatcccgtccagcttgccgtgccgtttacggatattgcggatcaatcggtatacttctgcttcgtccgtgacatcggtctgctcgtagaaaacagaagcgccggcagcacgtactgtttccagcatgtctttctgcttttctccgagagcggaccggccggttagtatgatgacggcgtcttttgtacggtttgcgatctcttttgcaaaaatcagacctaaacctccggcacctcctgtaatgagataaacgccttcgtctttccacggaatgtccggctccgcttgagaaatatccatctcttcccaatcagcggcaatgcgcttgccgttttcatatttcacatggacgctttcggcatgcatacggttttccgccgctttttccgcgatgccttcagcactttctttctcctcgacttcgatcatttgacagatcagcttggaatgttcaagacatgcggttttgaagaggccggtaatgcctgagaacacctgctgtaagcctgctgaccgcgtaacagcctgaaaaagaacgcggcccttcggcttgcttttcattatggttttgatatggccaaacagctgacccgcataagaatgataccgctctgcaatagatgcgggacgatcgtccaggataatgacgcgtgcatgttcaagctttgcttcgacagcttgtttaacggcttcatcgtactcacaaaggaaaatgatatgctcttcatacgaaggcgcatgatcggccggtgccgtctgctctttccagaccggttcagcgaacaatgtgtccgtacggctgaccgaaacgccggcacccgcgttttcttccatgatccgcgttgagaaacctctcatccgcacacaaagccagccgttattgtcatataaatcaatatctgctttttggataggatcgccggctttattgttcgcactgaatgtgacgtgcacccacatatcatcagcgcacggattcagaacgtccagctcctctaaagcaaacggcaatgcggctttgaatggttccccgctttctgccagcagcgctctcgtcacgttttgcaaatattcggcggcctgaagcgcaccgtccatcatactcggatgaaggatataatcagctttcgtatgggagagggattcaggaagcttcaatttagcaagcagccggtcttcgcctttgtatacaagctggacacctttatagccaggcccgtaatcagctccgatcattcctttgtaaaacgcttgagattcgattgttccctgcgtgcaccggcgcttcagctgctcaatatccgccgcttcctccggttccttccggatgatttcagcgatgccctgattataaagaggagcttcttcaccgatagaatcgttaccgccgtacattctgtattgaatctgtccgtccccttcttcataaagtccgatatggacacggacagcgtcctgatcgactatcaccgggcggacccatacgatattctttaagcgcaggccgagagaatcctctgttgccccgccgatgcttttctccgccgcggcccgtgccatctcaagggtgacggcagccggcacgatcgccattcctttaatgatatgctcggcaataaaatactcttttcccgtaaattccgaactgaaccgctgctcctgcaagacggatgtattctgatgtaccagcggatgcaaaaacttcgcatctgtttgcttcacagtttcttccggccagaagcgctcctctgcgaacgggtaggtcggcgcactgattcttcgcggcgcggaatcctgatacaataagccccaatcaacacgcgctccttcaatccagagcgccgcaagtgctttcagcttttcatcacgtgtctgacatgccgcaagctcttccatctcctgagccgacacttctctgcttctcactttttcgccccgtaagatgttttggtcattgccgttgatgaaatcctgcagctgacgcttcagatcgtgacgatcatgactgataaaaacggctctctcttccatcgcttcacgtccggtctgatacgtaaatgccagatcatgcaaggaaacatcgttttcggcttcatccagaaagccggataaacaagttgcataggcagtaagacgttgcttatttctcgctgacagcggaacgatataaggcggctgtccgtcatttgatccgctgatcgttttgttttcatactgttcaaaaatggcgtgtgcgtttgttcctccgagtccgaatgagcttaacgctgcccggtgcggcgtctctctctccggaagcgattttctcttatccgccacataaaacggcgaaccgctgaatttgatattcggattcggtgacgtgtaattaatggtaggcgccagctcccgatgatataaactcatggcgactttgatgcacccggccagacccgctgctgtatccaaatgcccgatattcgtttttacggagccgattccgcaatactgctcccggtccgtgtaacgtttatacacttgctgcagcgcggacatttcaatcggatcacccaatgtcgttcctgtgccgtgcgcttcgatataggaaatcgtctccgggtgaatattcgtgctgtctaaaacatgctggatgacgtcagtctgaccttttacactcggtgcgtaaaaaccgactttatccgctccgtcattgttcagaccgatgcctctgagcatggcgtatatgtgatctccgtcctgaacggcttgcgacgcctttttcagcagaatgacggcagctccttctccgcccgccataccgtcggctgaagcgtcaaatgccttgacatgcccgtcgcttgaaaaattcaatccgttttggtgcacatagccgatgcttgtcgctgcatgcagcgttgctccgccgacgagcgcgtattccgattctccgctcgtgatgcttttataggctgaataaagaccgactaatgatgatgagcaattggaatgaacgaaatagcttggcccttttaatccgagcttatgggaaaccatcgtcggaatcgtgccgctctgcgctaacacccatgagacatagccgtcaggagattcatggccttctgtcgttttttccggtaaaagcgaccgatacgaattattgcttgccgacatatatacgcttgtcttcggaatctctttggatacatatcccgcgtcctcgacggctttccaagaatgtagcagcagaagccgaagctgaggatccataaattctgcgtctttcggagaaatgtgaaagaactcagggtcaaagagatcttttccttctatcgtcgataatgccggcacatagtcgggattttcgatcaaatcttcaggtacgccggcttcccgaagttcttcttccgagtagaaccggacgctttcctttccttctcttaactgcttccaaaactcatgatgatttttcgcgccggggaactggcaggaaatccccactatcgccacactgtcgtcaaagtaagacggcaccccgttttgcggtgtttgttctctttctctctcatcttggcctgatgcctctgattcagccgcctgtttagtttcaacaataaatcggctgatcgcctgaatggtagagtgttcgaataaatccgtgacggtaaaatcgcattccagctcctgtttaatgcgttctgccgccgcaacagccaaaagcgagtcgcctcccacatcgaaaaagccgtcttcggttttgatgcccgccgtattcagcaggtcttcccatattgcggtcactttcgcttccgcttctgataacggcagtctgcccgtcttttcagaccggtgaacaattaccttgcgctgttttaggtctttgcggttcacttttccgctcggtgttaacggcagcgcatccagacggataaaatgggcaggcgccatataatccggcagactcgataaaagatggttgcggagcgctttttcatctgccgtatgaccggagcgggccgtataataagcaatcagctttttatgtccgttcttttcctgaacaacaaccgcctgatcaagaatgtccggatgttcgttcaatttcgtttcaatcgctcccaattcgatgcggaagccgcgaattttcacctgactgtcaatccggccagcatattctatatttccgtcaggcagccatctggccaaatcacctgtcttgtaaagcttttctccttcactaaacggattatcaataaatgatgccgccgtcagctcaggctgattgtaatagcctctggccagaccggcgccggccacgcaaagctcgccggccacaccgtcagggacggggctgagcttttcatcgacaatataaagccgtgtattttgaatcggtttcccgatcggcgtattcctgcttgtgatttccttttggccgcagctgtagtaagcggcataaatagatgtttccgtcgggccgtatatgttttcaattctggcatgtttgaagatggaaacggccttttttactaaatctttcggaaatgcctcaccggccaccatcacatatttcacagggccgtcttctgtaaatgccgtatgccgctttaccgtttccagaaatacattaaacacggcgggagcaaaattcagatgcgtgacctggtgggtttggatgtattccatacaaagctgcgggtttttttctgcaccaggcggcaaaatgacaagccgtccgtttccgataaaccagccgaataattcagaaatcgaaacgtcaaatacgtaattcgtttttaacaaataggcatcctcttgcgcgaccggatactcagcttccaaaaactgcagcgtattcatgatggccctgtgctcaaccatgacgcctttcggttttcccgtgcttccggacgtatatagaatataagcgagatgatgcggttttgaacgcggcgtcagttttgccccgctgacagaacgtccgctcttttcaatttccaccgtgctcacaccgccgacggccaactgttcaatcatgccgcgcgtatttgcttgcgttaatacgattgaaacgccgctgtcagtcaacacgtgcgccatccgttcgtttggaaaagccgggtccagcggcacatacgcgcctcccgcttttaaaatggcgaggatgccgatgaccatctcaaaagaacgctccgtacaaatgccgaccgggcattccggtgtgacgcccttttcttgcaggtacacggcgagcgccgtgcttcgttcatctaattcgcgatatgtaagactgttttcaccgtatgtgacggcttctctgtcagggtggcgtccggctttttccgcaaacacttcatgaatgcagcgctcattcggctgatgagatcggcttgcttcacgtttttgattgagcaggccggaacaggcttcaaaagcgatctccggatcagaaagcaccttttctgccagtttcatataatgctccgccatccgttcgatgaaagaagggctgtagacatccgggttgtacagaaattgcaggacggttcccgtttcttttttatagacttcaagcgcaagctcaaattcgccttcctgatgaatgtcttctatcatttcaatgccgagtgattgatatagttccgccagcttttccgctccttctgtccggaagaagttttgatagaaaaacgcggtttgaaaaacaggcgaaaccgcaggcgagcgttccgtcttcaattctttgacaagcgcgggaaacggatacgcggcatggtccagcccttctgccagtgtcagctgcagctccttcaaaaacgccgtaaaggatttggcgcccgtctccctgcttctgaccgcgatcatattaataaagtatccgatgacagattcaaattgagcctcagagcgccccatcgtcggcatgccgacgatgacatcttcctgattcgtatattgatagagcagccctttgaaaatagcgagatacacaacggattcattgacattatgtttttgggcgcacactttaatctgccggttcagttcatcaggaagcaagcgctgatacgcctgccctttgcaagtttgaaccgatgatctcggataatccgacggaagctcaagcaccggcagcggtccttccagctgctttttccaataagagagatgcgtttttcccgcttcgctttccagcagctctttttcccatttcacaaagtcatgataatctgcggcctgctgaaccatgacaggttctttgccttcacttgcttttacataagcgtccagcagcgccgacataaacgtcataagagagacgccgtcaaaaataatatggtgaatggtgattaacacaatcggctcccgcttcgcccgccggaatacatgaacacgcaggagcggcccggtttcaagcgcgaacggttcttttgctttttctttaataaacgaaagagcgtcacgcccgcttaattcagaaagatccatttcttcaatcggaaaatgccgatccgtatcttctatctgatacggaaggccgttttcctcttttatcacactggtcaaaatagggtgctggcgctgcacggacaaaagggcgtttttgaatgtctcgatatccagcttttgaaaacgaaagcataacggaatgttatatgcgctcatctccggaaacattttctgaagcatccacaaacctttctggccttcagaaagcggacgttttgcagttgtccgcttgaaagcctgaagcttttgttctacttcagcgatggtgagcgttcctgatctgtaggcatcgagaagttctttatgattcataagtcttactcccttctatgatgtcttgcactcttttaaaatctaatgtcccctcagagacctgtttcatcatggcgatgatctcctgatccgtgtactccttgttacccggagcggcggcttttgtttcagtttcttccgttcggtaaaacgttttgatcgtttctttgtgttctgtcaggtaatagctgatgacgtctccgagcgtggcatagctgtaaaataaagccggagtgacttcaatgccgtaatgactcgacaaaagagcggcaaatttggctaaatagatggaatcaaatccgaattccgcccagtttttatgcaggacgagtttatctttagatattttcagcagactgtgtatcagctctttcaaatccgcttcgagccgtttttccgtgctttcttccgggatgcggcggctcacggtttccaaaagcgcatccggttttgatgaatcgtcccgccgtatgcctaaaaatcgttcggcgcggcttcttttgccggcaatgacaaggcactgggtgttgtcttgagaaatgatgcgctcaaacagctcaatgccttcatctgtttctaacaggcgctgtccgcttgattgcaggtacatgcccgtcgtctcttcaccgccgacggccattccgccgtttttccagaccggccagtttatgacaaaagcgtttccgctttcggattgttcgtttttatagcgggcatacgccatttggaacctgttcgcgaccgcgtaatcacagcatccaaaatctcctaaaacagcagatgtggatgaaaagtagcagatgaaatcaggcgtttcgtttttcagccactcgtcaagaagcaggctcccgtttattttcggttcaagcgtactgcggaaattcctgatttcattttcaaagacggatgttctgctttcgatgcccgccgcatgaatgacgccgtgaatagctccgaatcgttctttcgcgcgcttgatgcagtcgcccattccgatcggatcacaaacatcggcttcggcgtaaagaacacccgcgccgagattttccaggtctttcattttttctttcttttcttcattgatcggcgaccgccccgtgagaatgacatttgcctggtagttccgggcgagatggcgggcaaataagtagccgagccctcctaatccgcctgtaatgagatatgttccgccggttctgatcctgccgttttctttcgttagtccggttggttcggtgtgatagacatatcgttttccctcttccaagaaaacggtatggtctgtttcagctttcagctcgtcccaaatggttctcatccagtccgttatggccgcgccggcttttcggaagtggccggtaacacttgttttcggaagaacaatgccgagcgaacgctcaaagccgatccatgattccaagtagcacctttccagaccggatgcatattcccccgccaataacagcctttccggctgcagaccggtctcagccattgctttgagaatatggacaatacatgaataatcttcgatgcagcttttatcttcaagcgcccataaatacaaaatggcagaagcttcaccgtactctttttgaatatccgcaaaagcgttcacatatgattgcggatcttcccgcaccacttggcagcggccggcggacaaggcctcataccggtctccctgagcgataaaaataacgtcaatgtcactgtcatacgatttgatcacagagacggcttcctgctgcttcttctgatcagttaagaaagaaatcaccgttttgacttgcttttctccggcagccggcagagcctgttctttaagaacttctctaaaagccattacttcaaactgctccgccggatcactttcatcagccggcgccttaacgggcgcggccttgctttgtacaggctgctgatgccagaagcgttctttcgcaaacggataagcaggcaggctgatgcgggccggaggacggtctccgtataatttcgcccaattgatgtccaatccttttacccaaagctcaagcagcttagaatatttccgtttgctgatccaagcgtctatgatggtttccatgtcatcatcggccgcaaatacggcaagcatccgtttgttttcttccgtgccgtcacggtgcagtccggcgctgttttgtccggcgataaatccgttcagtttttcctcaagttcatgaagtgaatggacgataaaaccgagacgctcttccatcggcacccggccagtctggagagtaaaggctatgctcataagatcgcggccgctgtatcttttttcacggatggcgtctctgagctgttttgctttttcagtgagccgttcgctgtttttcgcggacaggacgatgatggcgggctgatctgccggcgtctcatcaggctctttgtctgccgtatattcttctatgatgaggtgggcgtttgctcctcccgcgccgaagctgcttaaccccgcccttctcggaagctctttgccgccgatgacgggacgtttccactcaccgagctcctgctgaacggcaaacggcgtatacgcgaaatcaatatttgggttcagctgttccgcgtgcagggacggcgcaatttggcggtctttgagctggaataatatttttgtcagacccgcaatgcccgctgcgctttcgcaatggccgatatttgattttgctgagccgatggcgcaaaactgtttgtctgttgtatcctcatcaaatgctttcgttaatccggcgatttcaatcggatcccctaatgcggtccccgtgccgtgggcttcaatataactgacggtgcgcgccgggacgtttgccctttcgaaagcttcttttattaaggcggcctgcgcattcggattcggaacggtgtatccgttcgttttgcctccgctgttaatggcgcttcctttaatcacaccgtaaatgtgatcgttgtcggcaatcgcttgctccaacggctttaatacgaccgcgcccaccccttctccgtctacaaaaccgtccgcgcggtctccgaacgatttgcacgtgtcgcttgcggaaagcatgttcatgactgacagattcatataatgaatcgggtcggtcactatgtttacgcccccggcaatcgcgcattcgcttgaaccgctgtatatgctctcaagcgccagatgaatggctgtcaaagaagaggagcaggctgtatcaacggcaatgctcggcccttggaaatcaaaaaggtaagataccctgttggcaatggaccagtagccgtagcctgtcgggtagtttttgttcatcgcgccggcaaaaacaccaatttttctgctttggcacaggttgtcaggcgtatagccggcatcctcgatactcgcatacgccgtttctagaaataatcgctcctgcgggtccattcgctccgcttccaaaggagaaatctgaaagaacagcggatcaaacttgtccatatcctcaatgaagccgccccatttcgtataaatagagccttctttacctttctcttcatcgtagtaatcctgccagttccagcgttcctgcggaatttcttctatgcagttttttccttttttaatattggcccaaagctcagccgctgtttttgcctgcgggtagcgtcctgaaacaccgatgatggccacgtcgcgaaccgaactttgccggacggtctctctggctgcccgcttttccctccgccgccagtcagtgcgaagcggcttggccggctgtacagcctgcggttctggtgatgccttccgttcttcctgaacaggcgtttgtcccgtcagtttgatcatcgcgtcttttttcgttttgattaagtgagcgacgagcgcttcgatcgtctgatattcaaaaaataaagtgctgctgacttggtccaatacatttcgtaacgcgtttgtcagctgtacgacgacgatagaatcaattccgtatttttcaagcggcgctttcggatcaatttgagccggcggaatttttaacgtttctccgattaacgttttcaagtactcggtgcttttttctgttaaagacgtgtcgcctttttgcaccgttgtttgcggcgctttaaattccggcgcttgtgctgcttttggcggagcggtccgttttccggcccctgctttaagcgttttttggcggacaacgccgttgctttttgccgctataatctgatggcttaattcatgtgccgcttctgccgggaagaagacagaatgccagccttcactttctaacacgcgcttccagctttccggatacaagcccgggcaccccggaatacgaagggcagaatcttcatgcagccaccagccttcaagcagtccgaaagtaatatgcgggaacaggctgtttcccgccatttcatttaagagcagcaaaccgttgtcttttaagacggctttagcgtttctcagcgtctggcggatgtctttcgtcgcgtggagcacattggcggcaacgacgatgtcgtatgcgcccggctctatgtcctggccggcaagcggcgcttctgcgttaaaaagcttatacgtcagataaggattccgtttgccgtattccgtctccgcatgcacgagaaaagctttcgatacatcggtgtaacagtattcttttatatggttttgatacggcctaagcttttcaaatatgcctgcgcttgtgccgcctgtgcccgctccgatttccagtatgcggatctcggcttttgaatgtttgctgatgttttctttcacataagccgttaatgtttctgacagggcgctgttaaagtaatccgcgacttgattgtgcttataaattccttcaacaagttccattgaagagtgcgggaacatgatgtcagtcgccggcacgtcttcgcgcagaatgtccggcagtgctttaagcatcgtctcggctaaaacagtcatcgcttttgtatcggcgttattgagccattcctctttttcctgctcccatttttgccatagcgaggcggttgtgtcttcggcacgggccgacagtttatatgaatccgcattcccttccagataaccatgttccagaaggaaagcgatcgtttgattgagccattttttaaaatattcgtgttcgggctcatacgctttaaggctttgcggcgtcagcaagtctgcttctttaagctgggcgatcaaaagccgatacagaaaatcatcgagcttttgatgttcagcctcttttacaagacgtgcgccgggcggagcggccttcagctgttgtgaagagacaagcggctgagacggataaacggaaattttttctgtttcactcatcccttcgactgcgaccggttttgtcgtatgaatgaaagctgcttgatcaaccggcagcgtcataagggtttcaagcgcctccatcgcagcgtccggttcgatcaatcccaatccgatctgatccatcagctgaataaaatcgccgtcttcagccgcttcgctgttgccccaatagccccaattcatgactttgaccggacaattccacgtctgatcaagttctttcgcaaatgcgtcactgaaagcgcatcctgcggcatagtggctttgtttcacgttatggataaatgccacaagcgaggagaagaagagcgcaaagtcaagcggctcccgtccaaatacctccgccatggacacactgacatcggcttttgcccgcagcaccgatttgaactcttctgtcttcatattatttaagctttgctcagacagatccattgccgagtggatgattccgttcatttttgtgtgacgctcttttatgaactgataagcccgctctaaggaagcactgtcagcggcatcggcggaaacatattcaggcgccgggccgaatgcgctgagccggtcgagtttcgcctgtatggaatcattcagtgtgcttcttccgatccaaatgatatgtgctttgtagcggcggatcatgtattcactccatgcctcgccaagatatccggcgcctccgatcacggcataaaccccgcctgtttggtacagcgtgccgtttttcggcatattgtcaagcggtatcagctgccgctcaaacagctgctgattgcggtacgcccaaatttgaccgttttttccggcagaaagactgagcgcctctttgaccggccagctgccgtccgtttccgtgtcaatcatgcggatattccaatgcggatattctttcgccattgttccggcaagtccgctgactgcggcctgtgacggggcggcgctgtcttgatcggaaaacggctgggcatttgctgtgacgatgcaccagtccaaatgtttttctccgtaccccaaggcaagtaatgctttcatcagcttgaacacatgaagaacgtttctttcctgttccttgaggctgcaagcactctcagcctgcggagcaagccaaatgatttgctccagctctttttgtccttcaagcatgtacgtaagagatgtgatatcatccgtacctctgatcggataataggaagcgttcggcagatgttcttttatgcgcgtatgcgttctgtcagtttcaccgaaaaccgcagtctgcttttccgctgtttttgctttcttcgttttttcaagtgcaacgggctcccatgccggaatcagcatcgtatggccgacaggcgcttccggggtttctccgcccgctgtttggcctgtgtcaagcgcccggacggacgcgcctttcatccggacataaaccgtaccggcatcatcgcacatatcaatgtcaaattttcttacgttgtcatctgctttgctgccttctgtgtaccggatatatgaccagatatgttcaggacacggcccgaacacttccacttcctgcatcgcaaacggcagagaaagctcgtggctgtctgcatcgtcatgtattgagcggacaagcagaccgacggaggcgtgaaaagcggcgtccatcatactcgggtgaagcgtatactgttctttattgtcatgtacggcagccgggagtgaaatacgggccaataatcggtcttctccgatcagcaattgctgtacgcctctgtatgcctctccgtaatccagaccgatcttctcaaaagcaccgtaacattcttccgcagtcacggtccctgaattgcaggaagctttgacagactcgatatcaatctgggcgctttccggttcggtaatgaccgcttcaccctggctgtgaataaccggatcttcgccgttttctgcctcactgtatatttcataggtaatctcaccattatcttctgggtaaagggcaatatgtatttccttcggtttgtcttcaatcatgaccggccggacccaaacaacctgcctgagtgtgacgctatggtctttttccgtcacggcagcagcctttttaaccgcctctctggccatttccaaataggcaacgcccggcagtattttttgtccgttgacgacatggtcagataggaaaaattcatctccagtaaaaagagacgtgaagcgctgctgcgaaaaatctgacgtgttttcttgtaaaagcggatgcagcactgtgcctgacgggcttttctcctgttttttctgctgcggaatccaatagcgttcttttgcaaacggatacgtcggaacgcttgttttacgcggtttacccgaagcgtacagcctattccaatctattattttcccttctgcccataactcggcaagccgtatcggatcatccgtctcgggagcggtttcgctcagttccggcagctcggcttgtccgcgccaaagaccggggatgttttcgtttccttttacgaaatcattcagcttttctttcaagtcgcggatgtcatttacaaggaagacagctctctcttccattgcttcacgtcctgtctgaagtgtataagccagttcagacagcaccgtcttttctgaaagcgatcgggctagtttttccgcataggccagaagcctgtctttatttcttgctgacagcgggatgagttttgctgcattgttctcaggtgcaggcgctttttgttcaggctgaatgtattcttctaaaatgatatgggcgttcgaacctgatgcaccgaaggaactgagtccggcccggcgcggataatgtgtgacttttccgttttcttcggctgccggctgcttccacggagcagtctgctgctgtacgtaaaaaggagatccctcaaatttcaggtaaggatttaattccgcagaatgcagtgatttgacaagcgttttgtgatgaagctgcagcgccgcttttgttaacccgctgatccccgccgctgattctgcgtgaccgatatttgatttgaccgaaccgatggaacaaaattgctgatcctgcgtcccttggctgaacgcttttgacagaccttcaatttcaatcgggtctcctaacgaagtacccgtgccatgggcttccacataactgacggtccgcgggctgatacctgcttttttcagacaggccttaatgacttctgcctgtgcagcaggactcgggacggtaattccgcttactttcccgacgtggttaacggcgcttcctttaatgaccgcgtaaatgcggtcgccgtcttgttcggctttttccagcggcttgagcaagaccgcaccgactccttctccggaaacgtagccgtccccgccctcgccgaatgtgcggcagcggccgtcacttgagtgcatccctacgcttccgtagctgagatatttcgccgggtgcagcgacaagttcacccctcccgcaagcgcggcttcacattcgccgcggcggatgctttcaatggccagatgaacggcggtcaatgatgaggaacaaacggtatccaccgcgatgctcggcccgtggaagtcacaataataggacactctgttggcgatctgcgcataattcagtgaaaccggaaaaggatcagcttcagataattgttctgcgccgattaaggaataatctttatgcatcacccctgcaaatacgccgatcggatgctgtttctcccctttattccccagcgtttcaggcgtataccccgcatcttcaatcgtttcccagcatgtttctaaaaacaggcgctcctgcggatccatcgtttccgcctcacgcggtgagattctgaaaaactgcggatcgaaacagtcggcatcgtcaatgaaaccgccccattttgatactgtttttccagacggggacgttacgttttgatatgttttccaatcccatcgggacttcggaacttcagtgatgcaatcggtgcctgccttaaggttttcccaaaactccgccacacttttcgctttcggatagcggccggccattccgataatcgcgatgtctccggtgtttttatgatgttctggcgcgtccggcgcttcagcttcagatcgtgatgattcggctgcacgttcctccgcatattcaaatgaaccagtctttttcagaaaggctgcgagttcttttatatttgtatattcaaagagaagagtgggcgcgaggtcagcacccgtctttttactgatatcctgtacaatctcaagcaaagaagatgaattcagtccaagctcgtagtagcctgcaagaacgtccagcgtctcccaaggttgcccaagcttatcagccaaaagcttctttaaaaacagaatgatgtctttttcatctgcgctttccggctcagctgcagcctgttgattctgttcggctgtattcgcgtcttcgagccgaaccgcttttcccgtaatgtttttaagctccgccaccttttgtccggatcggctgaagtactcgatcgtcatcgttgtgagttctttttcctgacggacgccggaagcggcgatacgcgccgtgcactctgattgaagcctgtcagcggccgtgaacgattcataatataaaggcaggtgaagccggtttgtttctgaaagcaaaccgctccccccgattccgctcgcatccaaaagggccggatggaataaaaagaaatcttttccttcttcgcaagaaagctcagccagcatgccgctttctgtttcgtacaattgtccatttgatttcatcatgccggaatgaaccaagtcatgatccagacagcggttatacatatcatcaagattcagagacctggctgactgcttcacatcgctgaaatcaatgatttcgtcaaatgtgacagcgtctcttttcaccatttcagccgtcgcatattgtatattgtctgacagctcgtcaccttgctgtttctgccctgaaagggagatgagccactttccatctccgctatcagaacattgaatggtcagaatgattgcagccgtttcactgacggttaaaggctgataaatcgtaacgtgcttcaattcaagctcattgtatacataaccgtgttcctgaaaaacctgataaatcaaatcgatataagcaagaccgggcaataccgcttcaccaaagaccatatggcccttcatgatgggatgatccagtgagatattgattttttccgatatcattccttcccactcctctcttatttaaatgctttccaaaacatttttttcgcaggaagctcttgtttctccgctcgtacgtcaggttcttttaccagagccttacgtcttaatgacggtaccggcagcggctttcttttcattcgggtatctttttcttcccaagcttccagaatgacgtgggcgttcgttccgccgtcggcaaagcagttgatggctgctgacggtctggctgcatcccattcgccggctgttttatgaaagtgaaaatctgtctttgttatatcaaaatgcggcatcggttcgtctcctgagagaaacggaaccgtttgtttatgcttcagcattaatacgactttaatgaagcttgcaatgccttctgcgcaaagcggatgcccgatgttcggcttgattgacccgatgccgagcggaacatgctgacctgagcggtatacggattgaatcgccttcagctcaagcaaatcagtcaccgcggaacccgatccgtttgcttcgatataagtgatgtcttccggctttttgccgcttttgagaagcgcgctttgcataacgtctttttgcgcctgcatattcggggctgacgggcctgccgttctgccgtcattgttcatggcggcagccttaatgaccgcgtgtatcgtatcgccgtctttttgcgcctggcttactgtttttaacagcaccatgccgacgccttcaccgaggaccactccgcctgaacgcttgtcaaatacgtgaaatgccggtttctcgtttaacagcccgcgctcttggaacatccggtgcgccgcatccgtgttcagcaggctgacgccgccaactaccgccgctttgatatcgccgcttctcagtgcctgaacggccatgttcattcctgtcaaagctgatgaacaagccgtatcaagcacgatactcggcccgcgcagatcaaaaaattgcgaaacgtttgccgctaaataattctgcccgcccgcaacaatcgggttgcgggtattcgcaagactttcaggatcaggctgatgctggctgcggcctccgatatacacaccggcttctatgcccttgatttcttcacgggtatagccggcatggcaccaaagtttcaagctctcttccagcaccgccaacgcctgagggtccatcgctttcgcgtcgttttccggaatgaaaaagaattcggaatcaaagtgatccatattgtcaatcaatcccgcaacatattgatttgcatatccgaaacgttccgccgggacggagccgattgcggacctgccgcttctcagcaagtcccaatattgttctaacgattccgctcccggaaaacggcagctcattccgacgacggcaatgtcttcagttacagcagcacgcttttgctcagtgtgaaccgtttgtacggcagccggaaccaacatttccgtatcaggttcctccctttctgcaagcagcggctgcccattggatacaagccattcggcaaacgcgtcaatcgtcggatgttcatataaaacagacggatctaagtcctctttgagcgcttgattcatttgctgtaaaagctgcgctaaaatgatcgaatcaaccccgtaatcctgaaacggttcgtctgtttccagatcttccggagcgattttcagctcatcggaaaacagtttcacaagccatgccttcgtatcaagaagcagttctctgtctgaatgtttttccgcgtctttgccgtttattacggcttcagtctctttttgttttttctcttgacagagcagcctgtcgggatgccattcgctccgatcaacgatagccggcagaacggacgggcggatgttttcagataaaatgcggtccagcaagtcaagtccttccgcgttggacagtcccagcagcccggtctgcttcaggttttctgtgcggatttcacccaatccggtttccttccagttcggccattgaatgctgactaacggatattgatgctgatgagccgccgcgaaataatccatgtacgcatttgccatcgcataatccgactgtcccgccgcgagtgccggaacgactgcagatactgaagaaaataagacaaaaaattgcaaaggatcatttgtgaaaaggctgcttaatgtttgaagcccggcgactttcggttcaagcacttcttgtatgtcgtcggcagtctttctgataaacgccggatttactgaattaaccgatcccgcacagtgaatgacgccgccgatcggtcccatcgtgcgccggatcgtttcaatttccgctgccgccgcgtcatgatcagacaatttcagactgatcaccgccacttgcactccttttgcttcaagctcttcaatcgcccgtatcttctctctcagcctcatattaacggctgtccgtttatgacggggaggaatcggctccctgcctgtcagcactacttttttcacgccgtgtttttctgtgaaatggcgggcgcataagagacccagtcccctcgtccctccggtaatgaaaagcacatggtcttcaggaaacggtgctggcttatgttctgctcgcttcccgcttggaatctcgctgaacaaagcacggtatctttgtccgtttcggcggcagacttccggttctgtgctgtccgccgaaaattcatctgcaatctgtttggcaagcgtctgctgatccgtatctgtatcggtatccatgtgtctggacgtcacgttttgatactcattttgaagcattctgtacaggccgctttttgccgctcctgcaagatgaatcgttttctgctgaaatggctccaagccttttgttacatatagcagcgtcagcggccgcgcttgccggcggcttgtatcaatcagagtctggagccggctgatcccttccagtgaagggtcttcgtctccgcatcccgtcagatcgattacgccatctatgtgattccaatcgctagctgcagtgtcagcggccgggagaatgaacgagtcagcgaaatgcttcgcagtctcttcggcaagttccgctgttcttgcatcagccagaatcatgaccgtcctgccgcttttctcaccggccgaatcgatctcacacggaacccattgcttttctaaaagcacagccttgcgccggtcttctgtttcctgcggtacggctttcggctcaggcagccagtacggctccttcgcaaatgggtaagccggcagactgattctgcggggtttttcgccttgatagagtctgtcccagtccgtctgaagccctttggcccacaattccgctattttggcgtattttttcttatcgaaccacgacctgacaagctgcttcagatcatcgtccgtttcaaatgctttgatttctttttttgccgttttgatgtgggcttcatatatcccttcacccgtatttccgtttacaaaatcggttaaacggctgatcagttcttctctcgaaccggctgtaaccgcaagacggtaatccatcgcatcacgcccggtctgaagcgtgtatgccatatccgaaagattgatattctgattggcttttgcaaattcgatcacagactcagcataggtttttacctgcggcgcttttttcgccgacagcacaaaaatgtttgtctcatcagacttgcggcttccccggtctttcggctgatactcttcgataacgagatgagcgtttgtgccgctgtagccgaatgagctgacgcaggcccgccgcggtgctccgcctgtttcccaaggtttaagttcggtattgacaaataaaggcgagtcatcgaaatcaaaatgttcattcggcgtgctgaaatgaagggtcggcacaagctgctggtgcttcatcgacagcagaaccttctgtacgcttgctacacctgccgccgccgacgtatgcccgatattcgatttaaccgaaccgatggcgcaaaattgtttgcggtccgttttttccttgaatacagaagataaggcttctaattcaatcggatccccctgctttgtgccggtgccgtgcatttccgcataggtgatgctctcagggtggatgttgtgcgcttcatacacttgacgctctaaatccatttggcttttcgcgcttggtgcggtaatgccgttggtttttccgtcttggttaattccagatccgataatgactccgtaaatatggtcttgatcggcttccgcatctttcagcctcttcaaaacgagcgcccccgcgccttcgccaggcacaaatccgttcgcactgttatcaaatgctttacattggccgtcaggagacagcattccggcttcacacatgctgatgtatgattcaggcgttaaatacaaggtgacgccgccgacaagggccatgtcaatttcatgattcaacagcgcctgacgcgccaaatgagtcccgacgagagatgaagagcatgccgtatcgatcggaatggccggccctttcaaattgagataataaggcaggcgggccgccgcgatgctgaaactgttgcccgtcgcgcttcctcctgtctgatgtttgtttaacatcattccgtattcattgttcataatccccaaataaacgccgcaattttttccgtttaattcttttgagctgtaacccgcatcttcaaaggctttaaaaccttcctgtaaaaatatccggtgctgcgggtccataagttccgcttcagacggagaaatattaaagaacagcggatcaaactcttcaatgccgtcaagcataccgattgatctgcagtatactttgcccttcttgtttaaggccggatcatagtatttgtttacatcccagcgggaaagcgggatgtcgcggatagcgtttttcgcacgggctaagttgtcccaatatgcctttaggtccggcgcatccgggtacttgcccgacatgccaactatggctatcgcgtccgctatctcgtctttaggctcccgtttggcctgcaccggttcaggttccttttgaaccgttaatctctccggctcggcaggtgttttctcctgcggggcggcttgctgtgtaagcggctttggacgtacgggaaccgcctgtttttttctgccgcggacggacggctgcgtacgcagaaaatcggcaaattgacggattgtcggataatcatacactttcgttacgttacagtccgtgccgtaccgtttattgacggcctttatccattcaagaccggtaatcgaatccataccgaggtcaataaaggcctcatcaatatccacttcatgccgctccatgtacaatacatcagccagtgcttttgataactcgtcatgcaccgcttcaatcggttcttccggttcggcggaagctgccgtttcagacatcgcctccagaatatccgcttctgcttgtatcacatgctgcttatgagcgtttaaaggctgcagcagtatgtttgacggtttttttacggcctctgttttctgcggttcggctgcttcctcaaggatcggttctgtcccgagttctttttgcaagaaggccgcaaactggcggattgtcggataatcatatactttcgtcaccgtaagggacgtgccgtacgctttattaacggcctttatccattcaagacctgtgattgaatccatgccgatatcaataaatgtgtcatctgcgtcgatatcgtcggcatccatatataacacgtccgccaacctttccgttaattcggcacttactttttcagcggataccgccggacgggaagcagactgtacggttcttttcggtttcgcgccgctcaaaggctgcaatgaaatgtttgacggtttttctttggcagtctcctcgtgaagagttgctacttcaatgaccggttccgggacggccgccggtgcgatcggcgcagactgtgtttcggccggtcttttgacagctgcatcagctgatgtgtcgatccaataacggtcttttgcaaacgggtaggccgggagactgattttttgcggtctgcccatttgatacagcttatcccaattcagcggaaggcccttcacccaaagctctaatacctttgcggctttgcctttttcaagccatgcctcaatggttttttccatgtcctcatcagccgcaaacagcgccatcgtgtctttattctgtttgacttgtccgcggtagagccggtcaattgactccttgccgcccgtaaattcgtcaagcttttcttcaagctcgcgcaaattgctgacaatcattccgagacgctcttccatcggttcacgtccgatttgaagcgtatatgcgatccggctcagatccgcttcttggtaacgcccgctccgcagcgcatcaagaagacgttccgcccgtttttgaagcctttgttcatttttcgcggaaaggacgatcatcgatggatgaggagcggcaaaagccgtctccttatcctcatcagcggtatattcttcgatgacgatatgagcgttgacgcccccggctccgaatgaggaaagccccgcggttctcggcagttctttatttattccgttttcatttatgaccggtcttttccactcttcaagcgtctgctgcactataaacggcgtagcgagaaaatcaatattcgggttaagcgtccgggaatgcagtgacggtgcgagcttcttatgtttcatttgcaggagcaccttcgtcagacccgcgatgcccgccgcgctttcacagtgcccgatattggattttgctgagccgatggcacaaaactgtttatcttgtgtttgttctgaaaaggcttttgtcagacccgtgatttcaatcggatcaccgagtgaagtcccggtgccgtgggcttcgatgtagctgactgccctcggatcggttcccgcgtcttttaacgcctgtttgatcaccgcggcttgggcgttcggattcggtacggaatacccgtttgtttttccatcatggtttacggccgttcctttgatcaggccgtaaatatgatcaccgtccgctttcgctttagaaagcggcttaaggagtaccgctcccactccttcaccgggcacataaccgtccccgccttcaccgaaactttcacatctgcctttgcttgataaaaatctgttctggccgagcatcaaatatttattcggatgaacggatacattgacgcccccggcaaatgctgtctcgcattccccgttccgcaagctttggcatgccagatgaatggctgttaaagaagaagagcacatcgtatccagcgccatgctcggaccgttaaaaccgaatacataggaagccctgttcgcaattgatgacggatttccggtcagcgcaagcgattttccgcgcgcctgttcttcggctccgtaaagctgatattcctcatacatgacgcctacgtaaacaccgacattggcgccaagcaaatcacccgatttttccgtgagctttttgcgcgtgtaaccggcatcttccatcgtttcgtagacacattgcaggaataaccgctcctgcgggtccatcaattttgcatcccgaggcgaaatagagaagaattgcggatcaaatttgtccacgtctttcaaaaatcctccccattttccgtacgtcttgccttctttatctttatcagcgtcgtaataaagactgtgatcccagcgatcgtttggaatttcagttatgcagtcagtgccttcactcaagttcttccaaaattcctgaagattttcggcttgcggatatcgtcctgatataccgataatcgcgatatcttcacgctccgtcactggatttttccgcgtgtctgtgcggacttgcgcaaagccttttttggcttcattccgtttggaaacgggctttatttcggctttttcagacagcgccggtttggctgcagaggtttcttctgttttcagcccggtcacttccagcagcgtgtcccggtgtgctttcataaaatactgcgccagcgattcgatattctgatattcgaaaaacaatgtttttgacaatgaaccgaagctcttttccagccggcccgtcaaatgcataatcataatcgaatcaattccgtaatcttccataggcgccttggcgtcaattttgccgacaggaagttttgttacttccgaaagcacatgtttcaagaaatgctccgttttttctgcaagcatgttctctccgcctgccgtaagacctgccggttcttccgtttcgctgcccttatccggctgatcatccgctgattttttcagaaacgcccggatttttgcggcgtagccttccgtcaccatgatttgggatgtgtttgccgcccacccgcggtacaaagcatggatgccgttttctgttttcatagggaccatgccgctttcttttgtcagcatcgcttccgtttcagcatcaaccgtcatgccgccgtctttccaaagcggccagcagattgaaagggtgtgtccatagcgttcatttcgggcttttttacggtttcttttttcactgaaggcgttcatgaacgcattggccatcgcataatcagcctggcccgcgcttccggcgcttccggctccggaagagaaaagaatcagaaaatcaagctcaatgtcctttgccgcttcatcaagatgaaccagtccggagactttcggcgccagcacatcacggatttcacctttgtgctttttcagaatataattgtcttttatcgttcccgcgctgtgtatgataccgtttaatccgccgtactgtcggcagatgtccgctgtgagcgattgaacttcttgtttttccgtcatgtccgtttgtttgtacacggcttgcgcgccgagatcggacagttcttgcagctggtcttttttacggttatccaacagagaacgccccgttaaaataagcacggcgtcttttgcatgtcgggcgatttctttggcgaataaaaatccgagtccgcccgcaccgcctgtgatcagataaacacctttatccttccacggcttttcggcgccgaactgttcaagccctgtttcctgccattgtgccgtatagcgcttgccgttttcatagcgaatatgtttgtcatcaggatgagcgctgcattcttttacatatcgggacagcgtgtctgccttgacgtccggctccaattcaatcagctggccggtcaggttcgggttttcaagcgccgctgttttcaaaagccccgttaagccgcaaaggagctgcgtatccgcttcttgaggcacgacaatctgaatgagctcgcgcccgccggaatttgaagcgagaattttcttcacttcttcgaacgcctgaagcgcacaagcttcaaaccgttcgtcttcactcttatgctgatcacggagcacgtgacagctgaagtctgtctgtatgctgttcatttgatccgtaaaccggtctgatatcatcacgtgacgggctttgaaatgagtcggcgctttttcatgtacagcggccttctcttcccatacgtgttcaaaaaatagtgtatctgttttatccgtttcaatttcccgtgcggaataaccagtcattttcacacatacattgccttgttcgtcacatacatcaatatccagcttctgcacggcatcttctggcttgctttcgccgctgtacgcaatggaaacccacatatcgcttttacagcttttcaacacatcaatctgttcgagagcaaacggcagcatcggccttatgtcatttccgtctctgtcaagcattaacccgattgtcgcgtggaaagccgcatccaaaaggctcggatggaggacaaactgatcttttgtatgagaaatagatgacgggagtgagagcttcgcgagcactttgctgtcttttgcatagatttccgtgaccgctttgtgagcatccccgtattcaatccccatctgtttgtatgcctgatagcaagcgtcaggtgtgatcagacggcgtgactctcttaatttgtcaatctcgattttggccggttcgccccctcggacaaacgccgcgcttccttgcgcatagagaacgggctcttgttccgaggaagccgattcaccgtaaaccgtgaagcccatctccccattttcttcatcataaagacggagatacagttctgcggattcatccgccgctgtaaacggacgtatccatacgacgtttttcagacggactgttccttcttccttcgtttctgccgcgtgttcaacggccgcccggaccatttccagataagccgcgcccggtaacgtccgctcgtttttgacgacgtgatctttcaggaaaaattctccgccgctaaaagaggaccggaaacgaacacctgacatgtttgatacattttcatgaaggagcggatgcagcatgcctgcccttttttgcggcagcgattctcttttctccgccttcggcacccaataccggattttttcaaacggatatgtcggcaggctgatccgattcggtttgttttcaccgtacaagagattccaatccatcgttcctccgccggtccacttttcggcaatcatctccagactcccggaagaaagccatttatgtatcaagtccggagcaagctctgcctgattgcttttatcggctcggttccgccagcatccgctgaccgttttacccgccagaaagccttccagccgctctttgagctgtgtcatattctgagcggtgaacgcaacccgctcctccatctgttcacggccgatctgaagtgtatacgccgcatcctcaagcggcaggccgggataaataaatgaagacagcttcgcaacatactcttttagccgttcttcattccgggcggaaaccgggaaaatgaaagtctgttcttctgccggttcatacgctgttctccgtgattcttcagggataaattcctccagaatgagatgcacgtttgaacctgtcgccccgaaagaactgatgcccgcacgccggggatatacggtctcgtttccgttttccgtcactgatggctgctgccatgcttcggtatgatgctggacgtaaaacggtgattgttcaaaatctaaatacggattcagctcctcggaatgaagagacggcaccaaagttttatggtgaagctgcagggcaaccttgcttaagccgctgatgcccgccgccgattccgcatggccgatattggacttcactgatccgatcgaacagaactgtttgtcctgtgtgtactggcggaacgccttgacaaggccttgaacctcaatcggatcgccgagagaagttcccgtcccgtgcgcctcaatataactgaccgtgcgcggatcgatgcccgctttgtccaggcattcttcaatcaaatcggcctgcgcgacaggactcggcacggaaattccgctcactgtccccacgtggttgacggcactgccctttatcaccgcataaatccggtctccgtcttttaccgcctctcgcagcggttttaataaaacggcaccgattccttcagccggtacatagccgtctccgtctttcccgaatgtatgacaaaccccgtctgttgaaaacatgtcccataaaccgtatgtcagatatttattcggatgcagcgacaagttgacccctccggcaaccgccgattcacattccccgcgccgaatgctttccgcagcaaggtgaaccgcagtcagcgaggatgaacagaccgtatcgacagccatgctcggcccgtgaaaattgcaaaaatatgaaactctgtttgcgatttgcgcataattaagagaaagcgggaatacatgatcttcagaagaagcttcagccccgaccaacgtataatccttatgcatcacccctgcgaagacaccgacgcgctgcctcttattccgtccgcgcgcctctgcgagcgacttcggcgtatatccggcatcctcaatcgtttcccagcatgtttgtaaaaacagccgttcctgagggtccattgtttcagcttcccgcggcgtaatccggaaaaattggggatcaaagcaatccggatcatcaataaatccgccccattttgaaatgctctttccggaaggcgactttacattttcaaaccggcgccagtcccagcgagactccggaatttcggtgacacagttttttccttctttcaggttttcccagaattcatgaatattttcggcctgcggatagcggccggccatgccgataatcgcgatatcttcatcttgcggaacactgcttttccgtcttctttctgtttgcttctcaacctgcttctctatttttgcaggagacgcgctgaaatggcttccgtactgctctgtcaggaaagccgccagctctgatgccgtcgtatattcaaacagcaaagtcggagaaagggtttcgccgattttttcactgatcgtttcgacgacgtcaagcagtccggacgatgtcagccccatttcatagtagccgacttgagaatcaatctgttcaagcggcttgccgattttttcagccatcagattcatgacataccgttctgcttcctcatgcgggtgtccgccttcaagcgatgccgcaacttccggtaaaccgactttttcaggaggcttctcagcagtctttcggtctgtattgatcagctcggcatcccgcacgagcttgcttgtgaaatctttcagctcggctacttttcggccggatgtgttaaaaaactccagtgtaatgtaaatgagctctttttcctgccgaagcgacgaacgtttgattctcgtgatgcagccggcctgcaaaggttcggaagctgtaaaagattcgtagaaaagaggcagaaacagcctcttttccccatttaacagcgaggagatcaataggtttgcgccgacgccgcttccgtcaagaagagtcggatggaacaaaaacccttcggcctgtcccatcgcgtcttttccgagcgatacatcaaaggtgacgccgtcccgctcctcaaacacttctccttccgctttcatatatccgctgtgaaccaattcctggcttctgcattgggcatacagctcatttaaatcgatggtgcgttccgcctcgcgtttgacagagtcaagatcaagcgtgtcactgaaaactgcgggtgccgtctcgtgcatttccgctttgacgtaaatacgttcttccggctggactcgtccgccgctgacctcagccccttttgcggtaagtttccagcgcccttcttttacctttgtacattcaaccgtaagcttgacggcgctgtcttctttcgcgataagcggctgatatatggataaatggcgcagctgaagcccgtcgtatgaatagccgcgctctttaaaaatctgataaaacatatcaatataagccaatcccggaaggactttttgtccgtaaacgtcatgatgtaaaataaacggatttttcagcgataaagtgatttgcttattgaagttcttcacgttaaacctccacttcataggtatcccagatgtttgccgcagctttttcgttcgtttcttctttgctgtccggcgaaatcagccgcttatttaatgcaggcggtgttaaagggtggcgcttgattcggcgcccttcgtctccctgccacgcttccacaatgacgtgggcatttgttccaccgtcggcaaagcagttaattcctgccgccggcattggtgacggccagtctgccagagtgcggctgaactgaatattggccttttctctatcaaaatgtgtgttttcatgctcacctgataaaaacgggataaagctcttttctttcagcatgagaacaacctttatgaaacttgcaattccttccgcgcaaagcgggtgcccgatgttcggtttcacagatccgattccgagcgggccggcgtcttttgaacggtagacggattgaatggccttcagttctaacagatccgtcacgaccgtgcctgaaccgttcgcttcaatatgagtaatgtcttccggctgttttccgcttttttcaagagccgtcttcatgacggatttttgcgcttccagactcggcgtagccgggcctgccgttcttccgtcattattgacggatgccgccttcactacggcataaatagaatctccgtctgcaatggcctgagacacggtttttaaaagaaccattccgacaccctcgcccagcacgactccatcggcgcgttcgtcaaatacatggaacgactgcgctttacttaatatgccgcgctgttcaaataatttatgggtttcttctgattcaaacaggctcacaccgccgacgacggccgcttttatttctcctgttacaagagcctgcacggccatattcattccgactaaagcagaagaacaagccgtatcgaggacaacactcgggccgcgcatatcaaaatattgagagagattggcggccaaataattctggcccagcgcgacgatcgggtttttcgcatccagcagtttctcttcacccggtctgtgacggctgcgtcccccgaggtacacacctattgcttctccctttatctcatccggcgtatagcccgcgtgataccacaggttaagacattcttccagagcggccaaagcttgagggtccattgcctttacatcttcttcagccagtaaaaagaagtccggatcaaattgatgaattccatcaagcattcccgcgtaataaggcgtcttcaccccccatcgctcagccggaacaggaccgatagccgaacggccttcagccaaaagcgaccagtacgcctctaaggaagccgcccccggaaaccggcaggacatgccgacgaccgcgatatcttcccggtgaatctgtttttcggccgcctcttcttgcaccttaacggcttgtgttacaattaccggctcagccggcttcttcataacaggctcagccgccgccaaatcaaaccgttctgacaaaacttctgtatacccttcgagaagccattttgcgaaagattgaatcgtcggatattcatacagaatggacgggtcaagcgatgccgagagattccgattgatccgctgcagaagctgagcaaggataatggagtccactccgtaatcttggaataatacgtctgtctcaagctgatcctggtcaatccgcagctcttcagaaaataattctttcagccattcttctgttttccttgttaattgagcgttgtctgcggcggtatcagcggttttttccgccgattttaccatagccgggctcattggctgatcctgcctgctccgccgcaggaatcgctccggcttccacagcttaggattcagaacggccggcagcaccgggccccttgctgattcaagaagtatgccgtcaaggagctgtaatccttctgcattcgtgatgctgtatagcccgctctctttataagctttgttcgttacttcgcccattccggtttctttccagttcggccactgaatgcttacgatcggcagctgctctttgtatgagtctgcaaaatagtccatatacgcattggccatggcatagtcggcctgtcctgccgaaagcgccggtatcgcagctgacacagaagagaacaagacgaaaaacttcagcggctcttcgctgagcacactgtataacgcctgaagcccctctactttcggctcgagcacgcgctgtatgtcttcatcggtttttctgatgaatgcgagcgtctctttatcggtcacacccgcgcagtgaatcacgccgccgataggtccgagcgtctgtttgatctgactcaattcctgtctcagcccggcttcatcagctaacgggactgacaataccttcacttgtacacctttggactccaagtcgagaacagcttcaattttcgcttttacagaagccgtcaccccattcagtccgcccgtccactcacttcgcggcggaagggtctcacggcctgtaagcaccagttttttcactccgtaatgttcggcaaaatggcgtgcgcataaaagaccgatccctctcgtccctccggtgatcagaagcacatggtggtccggaaaatcaattctctcgccttgcgtattcatattttctgaaccgctcaatacggcgcggtagcgcaagccgtccctccggcaaacttccgcgtcatcagtacgggcatgaaactcatcggcaatctgcttcgccagtttgtcatccgaaagcgctccttcaagatcgagatgccttgaagacagatgactgtactcgcatgccagcattctgtacagcccggcccgttttgctcccgttatttgattggcctttttccccattgactcaaggtctttcgtgacacaaagcagtgttatcccttctttatgcccatgctcaatcaattgctgaagccatttgataccggtcatatctccagaagcttcttctttcgctgcaccgagaaggtcgatgactccgccaaacgcctgccagtcatattcacctgtaaggtctgatgttgtgataatacggtgattcggcatatgcgctgcgatctcttctgcgagattgatcgtgtccccgcctgtcaaaatcgcaacggaacgtgggcacggttcacgcagttcgagcgggctcggttcccattgttttgtcagaatacgtttcatccgttcctctgtatggaccttatttttgtcaggattctcaggcacccaatacgtgtcttttgcgaacggataagacggaagactgagtaaacgcggcgtacccttttcatacagccggttccaattcaacacgccgcctttcacccatacctctgccagcttggcgaattttccttttttaatccaggcgtcaatgacgatgtccatatcttcatctgccgtgaacaaggcaaacgtatctttattgcggtgagactggccggtatacagcccggcgatgtttttctcatttttcgtaaatgcttccagctttgtttccaattccgccatcgtcgctgcaagaatggccaggcgctcttccatttcgtcccttccggtttgcagcgtataagcgacgcccgccaagtcttgatctgtatacggcgtttgacggatcgctttttgcagctgctgcgcctgttcgaacagtttttcttttgatttggcggacaaaaggatgattgccggattttccgggctgtgctcaggcagagcggctgctttcgggacatactcttcaatgacgatatgggcgttgaccccgccgatgccaaatgagctgaccccggcccggcgcggaatggcatttccgtttctatctttcgctgccgtccattcctgattttcccgcacgatgtagaaaggactgtcatcgagctgaatgtacggattgatcgtctcgcaatgcaggcttttcaccagcgttttgtgcttcatttgcaaaagcactttcatgacgcctgatactcccgcggcaagctctaaatggccgatattgctcttgaccgaaccgatgccgcagcggtgatcggagacttcaggctcttgatttgttttcgccagctcgtgaaacgccgctttcaaaccgtttatttcaatcgggtcgcccaattccgttcctgtaccgtgcgcttcaatatacgtgacggtgctcgggtccactcccgctttccgatatgctttcaccaataaatcagcctgcagtttcggattcggcgaggttaacgtattcgcccggccgccgtggttttcagccgtaccgcggatcacgccgtaaatcggattgccgtcacgttctgcatctgtcagtttcttcagcatcagaattcccgcgccttctcccctgacatacccgttggcatctttggagaaggttttgcattttccgtctttgctgagcatgcctgctttgctgtagctgatatgcgcttcttccgtcagaatcgtgttgattcccccggcgatcgccatgtcgcattctccgttttctatagcggataccgcccggtgaatcgcaacaagcgagcttgaacatgccgtttcaaccggctcgctcggcccgtgaagatttaacaaatagcttaaacggttcggaccgatggaaggaatcatgctgcctgtcgccgcatgtccttccggcgcaagacctgcccttgtgaacaaatctttataaccggtatttccggtgccgataaagacacccgtatttgtgccggaaaggctttccggcttacagcccgcatcttctatcgcccgccatgcataagtcaataacagccgctgctgcggatctaaatattgggcttcccgcggtgaaatcccaaagaacagcggatcaaattcagctattccgtcgataaagccgccccacttaatattcgttttgttcctttcaagattcgggtcgccatcaaacgcttgccaatcccagcgttctttcggaatggttgtgatagaatcttttccttctttcagattgcgccaaaattcctctatatccttcgcgcccgggaatcggccgctgattccgacaatggcaaccgggttcaagcggcgcggctcttgtgtcgctgccctagcgttcatcaccgttgcgaaacgctttttccgatgcgttttcggtttttgggcttttggctgctcttttttcggagactccttcttcttttcgccgaaacggcccggatgctcttttgccaaatatccggcgagattactgatcgttccgtactcaaagaaaatcgtcggcgccagctccagctgatacgcttcatttaattgattcgtaaagacggtaaaggatacggaatcaaaaccgtattcactcagttccgtatctgtatcaatgtcctcacggtcaacttttaaaatgctgcttaccatggctgtcaaagcggtgtgaagcgcttgaagagattcttctgcatcgtgtttttcttccggctgaaaaggaagacctctctctgtttcatccgacaaatactctgctaaactgcggatcgtcccgtgctcgaagaagatcgtcggtgccagctccagctgatacgcttcatttaattgattcgtaaagacggtaaaggatacggaatcaaaaccgtattcactcagttccgtatcaatatcaatctcgtcttggccgacttttaaaattgaactgaccaatctgataagcgcaccgtgccatttgtctcccgaaacggcggatacaggttctattttctccacctgcggcttttcagtttcagaaacggacaggaacgactgttttaattttgctgcgtgtccttcagctgctaaaagctgcggcttttcctgagccattccttcataaaatgcagccaggcctgacgccttttgaagcggaaccatgccgaaagcttttttcatcattctttccgtctcgtctcccgcctgcataccgccatctttccacagcgtccagttaaaggcgatcgtttttccgtgccgcaggccattctccgtaagggattgcctgtaagcggcgtatgcatccataaacgcgttgccggcggcataatcagcctgcccgacattgccgagaacgccggaaacactggagaacaatacgaaaaagtcaaggttgcagtctttgctggcttcatctaaataagcggtgccgatcactttcggatcaagcacttcccagaactcttccttcgttttttgcagcaggaaacggtcttgtatcacgcccgctgcgtgaataattccgttaagctccccgaattccgccgtaatctcttttatcagcgcttcattttcccgccggtctgccgcattcagctttttgtagacgacatttgcgcctgagtcctgaagcatagcaagctcacgctgtttggcttctgccagatttgagcggccggtcagaatgattttcgggtgttttacgcgaccagcgatttcttttgcgaacatcaaccccaggcttcctgcgcctccggtaatcagatatacgccttcgtccttccagacggcgccgccacctgcaggatgcatttcttcccaagccttcacataccgtttttctcctgtataacggatatgtttatcatgcggccgatggctgtcgtttttcagtttttgagcggcagccggcatttcgccgattgattccatctcgatgagctgacagtcaagttttccgtattccagctcggctgtttttaacaaacctgttaaccccgcaaacaattgctggctgccgtctgctgaaataacagtctgaatcagaatgcggccctgccttttttcgctgatgatccgccggatgtgttcggcgattgtctgcgcgtagccttggaagcgttcagcggctgtttctccctcaccttctgcaatcagcagctcggcgtctttcaggccggatgccgcttcatcttttatacggcaggcatcttcacaaagtatgatcaaatgctcatcagcatggacagaagctttctcggatgcggcggcttctttccaaaccggtgcaaacaagaccttttccgagcctgatggccgctgagccgattctgcatcgccttcaagcactctcgtagagaatcctctcaccttcacgcaaagcgctcctgtttcgtcgaacaggtcaatgtcggctttctgcacggaatcaccggtttgatatccttcgctgaagcgtgcatgcgcccgcatagtcggtgtgcatggtttgatgacttcaaggtattccagcgcaaacggcagaatcagcttttgtccggaaaactcctgcataatgcagatcgtcgccgtctgaatagccgaatcaatgatgctcggatgaagcgtaaattgtccgttcgtatgagaaacagaatccggaagctgtatatccgaaagcacttctttctcgccgataaaggcggacttaatgccttggaaggcttttccgtggaacatccccctgctccggccttcccgataaaaggccgccggatcaagaatgtccgctgtgcatctgttttgtatggcagaaaggtcggcctcaggctctcgttcagcctttatgatttcagcccgtccttggctgtgcagcacttcttcatcgtcagcgtttacgctgtaaatgtcatatgagatgatgccgtcctcttcaggaaacagcgcgatatggacttggcgctcttgttcgtgaacgacgatcggtttcatccagacggtatgatggagcgttattctgtcttggtcttttaataagccgccaagcgcccgttttaccgcttcataagacatttccaaatatgccgctcccggcagcaccgctttttccctgaccacatgatccttcaggaaaaattctgagcctgtaaaccgtgagctgaaccgctgaacggccaaatctgacgtattttgctgcacaagcgggtgtaaaactgagactccggtgtgtgcggcagatgttttcttttctgcttttttcggccagtacggctcctttgcaaacgggtagaccggcacgctgatccgtttcggatgcttgtctttgtaaagcttgtgccaattaatggcgacacctttactccacatttcacagagcttcgttccttttcctttcgcaagccatttctcaatgagttcagcgctgtcatcatcatcagaaagccaggcaatatcttttgcctgctgtttttctcctctaaagcagcctgttacagccggcttatcattgataaaatcggcaagctgccgcttgagctccgcagtgccgcttgtgataaaggccgcgcgctcttccatcgcttcccttccgacttggaacgtgtaggcaagatcagcgaggccggcgtccgtttttctttccagaaaagccagcagctgttttgcgtactccttcagacgatctttttttctggcagacaacggaatgatgaacggaccggcagcgtctgctgcttcggatgcatccggatattgttcaaaaatcgcgtgtgtgtttgttccgccaagaccgaaagagcttaaagccatgcggtgcgctctgttctcacgggttaactctttcttttctcccgctacgtaaaacggagagtcttctaaatgaagattcgggttcggctctttgtaattgatgctcggcgcgatttcctgatgatataagctcatgacaaccttgatgcagcccgccattccggccgctgtatccaaatgcccgagatttgttttgactgaaccgatgccgcagtattgttttttatctgtatatcggccgtacaccgattgaagtgcggacagttcgatcgggtcgccgagttttgttcctgtgccgtgagcttcgacgtacgcgatcgtttcaggatggatgccggtctgatcaatgaccttctgaatgacctcagcctgtcctttgacgctcggcgcataaaatccgaccttatccgctccgtcgttattgacgccgattccgcgcagcagcgcataaatatggtcgccgtccttaacggcatccgacgcttttttcaagagcacggcgccggctccttcaccgccgatcattccatcagcagccgcgtcaaacgctttaatatgcccgtcgcttgaaaaattcagccccggctgatgaacatatccggcacttgattccgtatgaagggtcgcaccgccgacaagggcatacttggcttcgccggaatgcaggctttgaaaagccgaatgcaggccgattaacgaagatgagcagttggcatggacaaaatagctcggccctttcaacccgagtttatgagaaatcatcgtcggaatcgtgccgctttgggcaagcacccatgatacgtagccatccggcgtttccagctgtgctgtcgtctcctccggcagcaggctgcggtaagagttcgtgcttgcagacatatacacgcttgtttccggaatttcttttgagatatatcccgcatcctcgattgccttccatgaatggagcaaaagcattctcagctgagggtccatatattccgcatctttcggtgaaaagccgaagaaaccgggatcaaacatttctttcccctctaaaactgatttagccggaacgaagccgggatgatcagccagttcttcagaaacaccggatcggcggagctcctcttttgaaaagaagttgatgctttctttgccttctttgatgttattccaaaattcataatgatcttttgctcccggaaactcacaggatataccgataaccgcgacactgtcctcataataatcgggaatttctcccgctgggtgttcccggtcttctgtattcactttcttttgcggcacaggagccaaaacggtttctttcagtttttgttctgtgatgtaccggctgatgtcttttaccgtcgcgtattcaaacagctccgttacactgaattcacaatccagttcctgcgtcatccggtcagtgacagtcacggcaagaagcgaatctccccccgcatcaaaaaagcggtcatcaagctctatatctttgcttttcaatacatcctgccaaatcgccagcaccgcctgctggatatgagatgatgaaaatgtttgtgtgtccggctgcttttccgtcagatcgcgggcagcaagaagcttgcggtcaacttttccgttcggtgtgagcggcagctcttcaagacggataaacgaagctggcgtcatataggccggcagcgcttgtttcaaatgattgcgcaattcctttgcagacggaagcggctctccgtttttcaggatataaaatgcgcaaagtttttcatttccggagtgattgttcacaaccactacgctttcctgtacggccggataggcattcagccggctctcaatatctccgggttcaatccggtagccgcggattttgacttgggtgtccatccgtcccatgtattcaatgcggccgccgggaagaaaacgcgccatatcgcctgttttataaagctttgatcccaattcgagccggtggctgacgaaaacgttatctgtcagctcaggcttgttgaaataccctcttgccaatccgtctcccgcaatacaaagttctcccggcatcccttctaaaacagggttgagagcggaatccataatatacacacgggtattggcgatcgggcgcccgatcgtaagcgcgctctcattttccgttatacgctgcaccgcggaccagattgtcgtctctgtcggcccgaacatattccaagcctcacttttcgtatcgagaaactgctgcttcaattgttcgctaagcgcctctccgccgcaaaggattttcactttttcttcatttgaccatccggaatgaaagagcattttccacgtaaacggcgtcgcctgcatgatcgtcggtttgtactcttgaatcagctctttcagcttccgtgcgtcttttgtgaattctgtcttacagatgttgcactctgctcctttgattaaagggaggtaaagctccagtgccgcgatatcaaagcaatatgtcgtgacggcaagcagtttgtcttcggacgtaagccccggttcattcgccatcgagattaagaaattggtcagcgcccggtgcggaatcatcacgcccttcggtttgcccgtgctgcccgacgtgtaaatgacgtacgccagatcgtcaggtgtcactaaccgcttcagcgacgttctttccgcggctgtactttcaatacgagaccaatcgcggtcaatggcagttgtctgcacgcctccccagttcaaggagtgctctaaatcagctgtcgtcagacacattgaaatcctgctgtcggcgatcatatattccaatctgtcagcgggataagaaggatcaagcggcacatacgctcccccggcttttaaaatgccgagaaggccgacagccatatgcaatgaacggtctgtataaatgccgatgagatcatcagggcctgcaccgtgcgcctgcaaatagagcgccagcttcgtgcttttttcatcaagctcacggtacgtcagcttttgctgttcatacacgaccgcacaagcgtccggcgtttctgccgcctgacgttcgaataattcatggaagcaggcatccggatattcacggcttgtctcattccaagtcttaagaatcatgtgctcctctctttttgtcatgagagaaacgttctcaagcggcatatccggattcgccgtcaaagcttcagcggcctgtacaaattggctgaaaagtctggccgcccctgcttcgtcgaataattcggtgctgtatttaatcgtaagatccatgcctgatgcttcttcccacatttcaaatacaagatcatattccccctcctgatgaatgtcttttacaaactcacaggagaattccttgtattcatccagcatcgattgatagcttgaatactgcagaaagttctgatagaaaaaggcattgctgaaaacaggcgaaccgttctgcaggggtttcgcatgcacatcacgcaccattttcggaaacggataaaaggagtgatccagtccgtccagaacggcatcctgcaccttttgaacaaagtcagcaaatgtttcttttcgtccggctctgctccgtataggaagcatgttgaggaaatggccgaccactccgtcaaagcgttcttcaggtctgaccatcgcaggcatgcctgtcacaatatcttccttatctgtatatttgcttaaaagcaccatatagcagctcagcataacggtagacaaatgaatcgaacgggatgcggcaaacgccgttagattattcagcagccgttcgggaagacggcgtgtcagcgtatcttctgtaaactccggaacgctgctgcccgtgcgcatcggcggaagctgaaggtcaggcagatcgcccccgagctgtttcatccagtaagcgcgggcagctttgctttcttcacccgctaaataccgcttttcccaagccgcgaaatcggaatgaatgccgggagcggcggccgcaaactcttcttttccctccagcagcgcctgataatgatccagcagactgtgaataaatgtaatggatgaaaaaccgtcaaacacgatgtggtgaatgaccgtcaaaagataatgttccgaggcggattttgaaagcagccgcacgcgcagcaaaggcccgccttctttgacaaacggctctttaacttttttccgtatcagagcgggtatttgtgattcattgacgtcagaaatatcttcttccgagaatacaaaaggatctgccgcttctatgaaataaaacccgccgtctgtttcattcacggcgcttttgagcatcggatgctgctttaatacgagctgaaacgcctgtttcagtttctctttgtcgattccggttgtgaatcggaaacagagcgggacatggtatgcagtcgtttcaggcgacattttctgcaatgtccacagccctttttggacttctgaaagcgctggcgccgtttgccgtctctcccgttctgccggcggttcggctttttgggaatgatgctccgctgacatgtttgccgctttttcagcagtataagccgctaaagcgccaatcgtcgggtttttgtgcagctctcttgccgtcagccggatgtgatacgttttttcaattgatctggcgagtttcatcatcttgatggagttaacgccaaggctttgaaacggtgtatttggatcaacaagctcatccgcgatggaaagttcctctttcagaaaacggataaaatcccgttcaatttctttctctgcagaagccggggctgaattgccgccttcttgtctgttattatgtaatgaatcaaattgcccttgttcgaatgaatgtttcagctgagtgcgctggattttcccgattgccgtcttaggaatgtcttcttttgcgaccggaagcagataatcaggggtaacgccgattctctgtgtcacgtgctggtgaatgtgatgaataagcttcgtcatgcggttctcatccaatggaacagacgtcacaaagaaaatcgccagctcatctgtcgtgctttgattcggccggacggcgcatgccgctgtatatgacgtttcaatttccggcaattcctcaacggctgattcaatggcgtggctgtaataattcacaccgttgataatgatggcatctttcgtgcgccccgttatcgtcaggcggccttcacgcagaaatccgagatctcccgtttcaaaccagccgtcttctgtaaagacactctcgtttaagtccgggcgctcataatatccgctcgttacagtcagaccggacacttgaaagcggccgatttctccttcttccaccacttgattgcggtcatccgtaattctcatattaaaccccgggatcggcagaccgatctcgacgaaacgatcgtcgtcactcgtgttttccagtgtaaactcatctgagaaaattacgcccgaagacgtttcggacattccccatgcgggacggatggcattagccggcagaccgtgcggctctaaaagctccataattctgcgtccgactttcgccaccgcggcctccccgccgttcagcatataacgcatggaagataagtcccatttccgtgtttgaatctcttctgcgaaatcggcaagcagcccaaaggcaaaattgggggcccacgtgaccgaagcgcggtaatgatcaatcaggtcgagccattttaaaggatccatcaaaatggattcgctcggtatgttgatttcctcacatccgagataaacatcacgcagatgaagcattccgatgccgccgacatggtcaaaaggcatccagttaaacgtgacatcctcacttgtatagccctgcatctgaatatttcctttgaccatgcagacgatgttttcatggctgagcatcacggctttcggcgtgcccgtgcttcccgaggtcaaaagcagcatcgccaaatcttccggacggggatgatgacagtccgtatccatttcatgcgcactgagatcttctgccgccaaagcgcaaaacccggaaagctcctgctcctccgcccattcagtcatctccggcagcacttcacggcttgtgatgacatacggctgattcaaaagcgtccaggcgtctttcagtttttgcgtcccgctgttcatttctgtataagccggagcggccgcaagcggaaccgggatcgctcctaaaaaaacacagccccaaaacgcaggaatcagctgggaattgtcactgagctgtaatatgacttcatcctgagccttcactcctgattggcggagccctttcacaatcgaaagagcgatctttttcaggccgctgtaagtctggtacactttggtgccgtcaggctgtatatatgtgatgcccttttgatctcccgctgccgcggcggttttgtgcaggacttcaggaatcgtcatcggctgatccgctgaaagccgcaatggttttccgtagctgacagatggcttgagtaacccgcttgccttcatatcacttttcatagagctgcctccatttcatctgtatgtaagatgtatgtcttatactccgtacatcgtcgtgattcgttttttcacttcatcatcatgaaacgtctcatcgtgcatgattaactccttctcaatgacagccggaagctgctcgcgaaacggcgtcaccaagtgccttttcaatgtaattaaagagtttctcggtttttccgcaagctcacgggccaattcctgcgcatagtctaatacttcctgccgcggaagcaccggaaaaggcactcctcttttctccaggtcaccgccgcggtagtggccgccgtttaacagcatttcatggccgaggcttgccccaagcttctccggaacgataaaggtagcccccattccgggagtgaaaccgtatttcataaagtttgcggtatacacgctttctttgcttaaaatgacaaaatcactgaaaagccccatgacaaacccgcctccgattccgtggccctgcatggctgaaataacggggatatcacattccagcgccaaagaatacatgcggtcttccgtaaacttcgtgatgccctgctgaatcctgagcagaccttcctgtgtgcctccggaagcaaagtaatggccgtatcctgttaaaatcacagctttatagactgacgatttttttatacgggtgaatgcttccatcaatccatccgtcagttctttggagaaagcgtttttatgggctttatcctgcattgtcacttggataatatccggttcaatttcgagcagttcaactgcggcgttcggcatgatatcctcctaactgttctccgtttcccaaggaagccgccccgtttctgcataacggaaaatggctgattggttatccggatctgaaaacatcgcttgattttcggctagagcaatggatttcgaacgatgaacaaggtcgtttaaggaatccatgtattttttatagcggatgactgcttttttcgacagcgggcgaagacgcagcaaatgctttctcagctctgttgctgagtccgggacgcatacgtcacaaagtccccattcaagcgcctggcgtgccggcacgggctttgtcatgatcgtcatataatgagccttttgaaatccgattctttgaattaaaaacggcagaacgcaggctggataaagtccgaataacagttcagataaactgaacgaagcactctcctctgcaatgacgatatcgcaggcggcggcaaaaccgacacctcccgcatttacttttccgcggacgcgggcgattgtgatgtacggcccggattttaatgccagccacaaacggtaaagcggctcctgcgattccgcatgctgcattccctgcctcattttccggtacatctcatcaaaatccgccccgaaacaaaatacctccggctgcccttcaagcactacggaggtcacggagtcttcacattcagtaagaacgtgcaggcattcctccactaaacgctcattaatcgtattgttggcttcaggccgatcaaaggtgatgaagcagacattttgctgaaaacggacgttgatcgtctcataggtcacgggatccacctgtatttccgatgaaattccgtgatttcttccaaatataaacgagggctcccggcatgatggtctaaaatgttcggaatcatattcatatccaatttgacattccgggttccgaacttcaccagaccgctgcctttaaacagttcttcatactcttccatggacagcctgtatctgttgttcagatgctcttctattttgaaagaatgctgccgcgtttgtccttcaggcgtcacaacgccgctgtaaaattctgaacagcatccggagccgtacgagaaacagccgatccgcttagaagtgtcgaaagccccttgatcaatcgtgcttgcaagagccagtaaagaggctgcccccataatgtttccgactctttggcagtagcggagccccggctctaccctggtttgaaaatcctgttcgatctcagcgtttttcgcttttgcaagcttacgcatcatcgtccggtgagctcctttgaccatgccgccaaacggtgtatggaaggcaagatagtgaaacgtctctttatagtcagcgcccggcacacggtttttgtactcgcgaaatgtctgttcgcagcaatcgagataagacatcaatgacaagtcggcgtcaccggcttcactgtccgggatcggacggcatgtatccatcacctcatagccgtaatagccgttggcgcccgcatccgcctgaaatacgattgggttttcaccgatcaataaggcgacggcacccgctccggcgctcggttcggcgtaagaccaatcctcgcttaacgcatcgccgccttcggcaattaaaaaccgggaaatatccgtcgcgacgacaagcgccttcgctccgggggatgtctgcgacaaaataaaattaagcgccatctgcaaacccgccgttcctgaataacaggcctgcttcagttcaaataaacggcagttccggttgaggcctaaataatcatgaatatatgtactgagtgattttccgaagtcgatgccggactccgagcaggtaatcagcagctcgattctgtctttttcagcctctgtcaatcggtcgataatcggctttgccgcattaacgccgaatgtgacggggtcttcgtacggaagcgccaccgctttttctttcatcagtaaattctcaaatctggcagggtctaagtttctgtactccgccagctgcatgacatcaaggtatgccgtcccgccaaacacatttatcgcttctattccggcagccgccatgaacttcgcctccaatatgaattttgagtttccgattttttcaccgttttatcagacagcctgtaccttttcataaagctttgccgccaattcgccgatgtttgacactcccgtcagctcaacacgcgggatctgcagtgataattcttcaagcatcatcgtgataatttcggcgcggtccactgagtccgcccccagatcaactaaccggtcttcctttgaaagctgttcgccttctaaatcaggcaaaacctcgtagattgtgttctgcagcaattcaaagattctttcttcactcattgtcagttcctccctgtttcatcttttatgaatattccatgttttcaatctatcatttcgtcttgtcaacacgtttgcagaaatgagcctaacttctgattcaaaagcgaggccgtctcttccataagacgaaggccgataccatcggcatggcggtttttccaggactccagctccgtacctttcacccattgattaaaggcgcctaatgccgggccgcaatgaatctggaagtctaccttggcatccgggtctcctttaatcgccgaagcagagctttgcctgaaataccatttgaatatgagcgccattttctgtttcggattccgttcggcttttgaaatgtcttcattcgaataatgagccttcactttgtcataaatactgcttacacttgccttaaaatacttctcttctatttgtctgagtgtcttttcatcaatttcttcaattgagcggtgacgctgatacagttcatgcagcttagaggcccgggtcggaaagaacagccctttctttaatacctgcaccttgctgcctgattcaaacatatcgccggccggcgcgtaggccgtgtcctgtacattcatctgctgcaggagatcctttacgaggccgctcgtcgctgcttcaacggtgcattggttaatggatccggtcacaataaaatcagcgccgagcataaatgcggccatagcagcctcaggcgttccgattccccctgcggctccgatgcggacggttttgccgtatcggtattttttcatcatgtcatctcgtaaacggatgatcgccggcatgagactgtaagcaactccgccgtcagtgtggccgcctgaatcagcctctacgcagatgtcatgcgcaacgggtatttctctcatcagacttgcttcttcagcggtaattttgttttcggctgcaagtttctgcagaatgtgatcaggcgccgggctgagaaatgcttccgctacttccggacgggacagctttgcgataatccgctgacgcgctattatttgtccgccggcaccgcgttttaaccccttagcgcgaaaccttactaaagcaggagtaaccgttaaaaatgctgatgcttccaagttctgaaccccatgcttcagtaaaagatcaatcattttttcttctgaatctgtatgcttcatgttatgtacaacatttatgccaaaggaaccgccgtcacgaagctcatgctgaattgacaaaatggcgtcctcaacgtgcgcgatgttcaaaccgcccgttccgaaaaagcccatcattcctttttcggccagtttgacgaccatttccttcgaagaaattccgcggtacatgccgccggccaagtaggcgtatttcaattgataatcgcgcttaaactcttcatttcctaaagactccgccgtaattgagctttttccagcttcagccgggactttgatttcatctgttatcggctccgcttcagccgtaattctttgaatcagccccgtcagcacttttccgggaccgatttcctcaaagatcatgttctttcttcccattaaaaaacggatgctgtctgtccagttcaccgatcccgttatttgtccggtgagtgtctttttcagctcggtctgctcataaggtcttgccgtcacatttgaaatgaccggaatggacagcggcttaaaatggaaagtttcaataaaccgtgaaaattcctccttcgcttccagcatgtatctggaatgaaaggcgccgctgacatttaagcggtgaaccatttttacgccgtttacggcttcaaaaacggatgcggctttttcaatatcttctttatatccggaaatgacaatttgctgcggagtgttcatgttggcgatatcaatcgtatgcaagtgatactcccttaaaacgtccgtcacctgctcatgagtcaggccgatcaccgctgccatgccgcctccttttgcgcggctcatcaggtcgcccctttttttgaccagctgtaggccttcttcaaaatcaaaagcgcccgaggcgtataacgcgttatattcgcctaaactgtgtccggcggtaaaatccggtttcaagccggtttcttctgtttttttcaaataactgagggcattgacgacatagagcgccggctgagtgaattgagtctgattgagacgttctccgtcccggcacagctcctgaatggaatatccgagaatgtgatccgcctttgcggttaattcaggatagcggccgaacaggtcctctcccatccctattttttgcgagccttggcctggaaaaacaaagctgatcatcttacagtctccttccgggcggtgataaaatgctgtcttctatttgctgcaaatgggtttgttctttatgaaacggcgtcataatggcacggatgcgttcagccgatcctgcgggaagaatctgtttggcaaatgcggccaacgttccggaaggcccggcatcgatatacaatcctttttggcggctgtctgcgaattgaagcgcttcgcggaattgaatcggctttcttacaatatcccagaaaaagtccgcttgtatatcggtctcagcctctccggtcgcactggagatgtacggtataaacggagtccggattaatttctgagctaaaaagcgcttgtacggctgttccgcctgatcaaccagcgctgagtgaaacccgtaagataccggcaatagctgatgaggaatctgcttttctctcagatcgtccatgatctttttgatatgttcccgctctcccgagatgacaaagtgagaatgatagtttacagatgccaattcactatgttcgccgagcagcggatcatcttgatataaagccggatcacccagtatcgcaagcatgctgccgttacggcaagtttccgtaatgattcgggcctgttccagcacgcaatctaaagcatcctcagcgctcagcacacccgacacagcggccgctgcatactctccaaggcttgctccgatcacataatcgggacgtatgcctctttgctccaaagcatatgcaagtgcgtactcagccataaaaatggcaggatggctgaaaagaaggcggtcaaatggatcagacagacgattgcctgtatgataaacctctttcaggacagagtaaccgaaacggctgactgcaaaatcgtccaagtcaagcattttctgccgaaaagcggcgttatgtgcaaacagctctttccccatttgatagtattgggaaccctgtccagaaaacatgaaaacaattggctggttcatttgttctcctttttgctctttatttttttaaaatattgatttgtaagtttttcttgatgttgtgtgcaggtgaagtggtcgtgatgttgtatggctggcactattatgtgagataagaattttgacttgcgttccgctacatggcgggtgaagcttcagtttcttttttgatgcggtgaataagtcctgtcagcacatggcccgggccgacttcttcaaattccatccgccctttgtccagcagatagcgcatgctgtcgttccatcgcactgaatggtcgatctgatcggccagaacggagtggattccgtcttgctcataaggcctggcatgcacattagaaatgacaggaattgatatagcagaaaaatgaaatgactgtaaaaatttttcgaactcttgttttgcttcgctcatatatctcgagtgaaaagcgccgctgacgtttaacggatgaaacatcgtaacgtcctttattccttcgaatacgcttttggctctttcaatgtcttctttgcgtccggatatgacaacttggtgaggagaattcatattggcaatatcaatcgtatgtaatccgtgcgtttgaagggcgtccgacacttgagctgcggttaaccccataacggcggccatttttccgtcagtggccatactcattaattcgcctcttttacggacaagctgcaggccggtaataaaatcaaaagcacctgctgcaaacagcgcattatattctcccaaactgtggccggccaaataatccggctttatgtcattttcttggatttttttcaaatagcttaacgcgtttacaacatataaagcaggctgggtgaactgcgtcttgtgaagattggaatacggattctcaagacaaagccgtttcatggaatatccgagtgtttcatcagcctgctccgttaagtctttaaattcatcaaacaatgagcttcccattccctgcttttgagaaccttgtccggggaatatgtatgtgatcattttctcagccatcctttctcggattcagttaagaagcatgttcaagttgatagtaacttcacaaaaataccatgtcaagttaatttatcctatgcggaatcctgaataatgcctatttttccctgacggaaggcggactcagggcttttggaatagacataagcagaatgtcccattcagcctgcccggcgcttttatccgcaaactaccgttactcagccattcatcaccaaaaagcgagcaatgactatcatttcaattcagaagttccgtggcctaaaagaaaaactagttagatagaaccaaattatacgctacttaaagtgaaacagccctttttgattttttctgttgcggaaattcacgaaatgttcttttttttcaatctgaaagtaaatattgtttttcaaaagactctccattttttgacccggcttctccccgaaggagtgccccggatacacacgcacatgcggcggaatagaggctttgatcctctgtatactgtgaaacatatcttcagctgagctgcccctgtcctcacatataccgcacccttctgtaaacacggtatcaccggtaaaaaggtgatcagatagcaaatagcacattcccccggccgtatgtcccggggtcaatatacttctgatgataaaccctccggccgcaaaggtttgtccgtcttcaagcgctattaagtttctgcaccggaattgatagaaatcgatttccgccgacgacatgtatatatcagaatgatagatttgctgaagcggctccgccaagtttacatggtcataatgcgaatgtgttaataaaatagctgataaatcaacatccaattcatgcagtttatcggttattttatcgatttcccaggacgggtccaccgctatcgcagatttttttgagcggtctgcgataatataacaatagttggaccacatctggtgataagttttgatttgatgcacttcatatgtatgatccattgtcaccattcccatttaaaagatccgggcagactgctgccgccgcccagccgactgtaaccactttaccagatggcaccacgtttttccatggattttccggtaaagtttaaaaaactttctgctcccgccaaaagcaccagtctgggccttttttacaaattgctatgctgatatataaggaaatcagaatattaattcagatgaattctttagggaattttattcagaaaatgaaggatgaatatgagtttcggataaaaagaaaacaaattgaacttttgttttgagaagcaattacagaagcggccggaggagataatcagtttttagaaatgacccgcaattaagattattatttcaatccttttcttcagataaactaaaccacacgggctctcgaaatatatcagaataccttagttcttacaccgaattcaacgttatgttgacattaacataattgaactgagaaaagtacagcttaatttacactctttttttttgcgagaaaaccgttcaaaaaccagtctagctgcaacaattcacgaaagcgtcgcgcatgaaaaaagacgtcagttgaagacgatttatatttgattattgacaaggagctcagatgtttttgttagggctaaataaagttatctttttactgtgtaaaaagtaaatattaagatttagacaaatagactatgtgatatgggtcggagtttactgttcaaggtgatttgtcctgagctataaaagcactgagagcagctcgggacgcaatacctactaaagttaaagctgctatgggtggaatcggcggttttgaaataattcttaatatcattgacaattttactggtgcagttgaagatgcgtgctatgcggatgctctaaaagtaactggtaaccaggcagcaactttgtgggttactaaaactcttatgcttttcctttaaatggggctattgttggtgtttaacaaatttatcctgtgttaagctttaaagtgattattttctaaagtgtttaagatcggaggtaactatggaagataaaagtaatgctgaaccgagcccgaaagctataagaattctaacttacatcattcctataattttaatagggcttatccttgtccttaagaatattaacaccgccgcagcggaaatttcattttatattgttgctgtcggtgtggttctcttagtggttttcagtttgatcaaaaatagaaaataccgcaggaagaactaaatgtaagggggctaatcactagtcccccttgactgacttgcggatagtataacccgccaaattccaattttatttaaattcttccccatctcttccctgtgactttgtaaaagcaggtacccgcatacagagtattcatcttgtacttcagggatccttcccaaataactggatgttaaacaaattatcttcatgatttacggtataccatgcaacaattatgccagaactcaaaagttatctctgaaaggctgggtcattcaaactagtaaggctgcttgtgggtaaataacagtttagtctcacataaacgttgttattacatcacacgcttaaacatcttctccatttcatacgtactgtggtggataatgatcggccggccgtgcgggcatgtgaacgggtctgtcgttcggcgcaggtcgtccaagagcgctttgatttcgtcgtttctcaaatggcggttcgctttgattgagcctttgcagctcatcataatggccgcttcctccctgagttttttaatatcgatctgtttggcgtcaagcacctgctgaatgatttcttcaatcagttcagcttcttccccttttggaaaccaggccggatggcagcggacgatgtagctgttcgtgccgaatgcttctaaaaatactccgacgctttcaagctcatgctgatgctggtcaatgatcagcgcttcatttgccgcataatgaaaggtgagcggcacgatcatatcctgcacttcaggctcgacctgcccgactttctcccggaaatattcgtatttaatccgttcttgcgccgcatgctggtcaatgatatacaagccgttttcgttttgggctaaaatatacgtcccgtgcatttggccgatcggatacatcaccggaactctttcttcccgtatttcttcagagtcagcctcctcttcaggctccggaatatcggaaacaggcgcttccgttaccggcatgccgagctccggcggcactccgtgacctgcttcatccggcagggactcttcttctatgaccggctccggctcttttacgaccgaactcagcttcatcggtgagtaagacggctccggcgttttttcaggaagtttccgctcaggcgcgctttcctcgaatgtcataaattgctgttcgtttttggccggtgccggcgctgtttttttcgggagctgggcgctcggaataagccgctgcttttgaaacacttcctttatcccgtcacggatcagctcatgcagctccgtctctttgctgaggcggacttcaagcttcgacggatggacattgacatcgaccaaaatcgggtccatcgtaatttcgataaacgtaatcggatggcggccgatcggcagaagtgtgtgatagccctcatgcaccgcttttacaagcgggaaattcttaatgtatctgccgttaatgacagatgacatatagtttctggatgcacgcgtgatttctggaagcgcgatgtagcccttgacttcaaaatcaagcgagctgacatggagcggtatcatttttttcgcaaccgccgtcccgtaaattgcggccagcacatggcgcacgtccccgttaccgtttgtctgcaacagatttttcccctgatggcggagacggatggatacttccggatgcgcaagagcaatccggttgacaacatccgtaatattgccgagctccgtatgcacggttttcatatatttcaatctggcgggcgtattgaaaaacaggttggtaacgataatctccgttccttttctgctggaggatttctgttcagaaatgatattcccgccctgaagaatgagatgggttcccgccccctcgccgatgctcgttttgatttccagatgagaaacagacgcgatacttggcaaagcttctccgcggaaaccgagtgttctcacccggaacaggtcgttttcatctttgattttgctggtcgcgtggcggcggaaagcccgcttgcaatcatcggtttccatcccttcgccgttatcgagcacccgaatcgacgaaagccccgcttcctctatgtcgatttcaatgactgtgctgtttgcgtcgatggcgttttccaccaattctttaacgactgaggcaggccgttcgaccacctcgccggccgctattttattcgaaagttcatctgacagctggatgacttttgccaagtccgtcacctctttctattttaattttttttgcagcttgtacatttcattcatcgcctcaagcggcgtcatatcgagaatattgattgacttaaaagcttcaagcacttgtttttctttattagaaacagccggtgccttctgttctttttcaccgtcagcaaaaaaggacagctgtgccggttcttctttgacggcgggctttttctcaggtgccgccggaagctccggtttatctcccgtctgctcaagctgtttcaaaatctcctgcgcgcggctgatcagatcgtccgggagctccgcaagctgggcgacatgaatgccgtaacttttatctgcggctccttctttgatttgatggagaaacacgaccgttccgttatattcctctgcgcgcacatgaacgtttttcagctgaggaagcttatcttcaagcaccgtcagctcatgataatgcgtgctgaatagtgttttagcgccgatatgatcatgaacatattcaataatcgcctgtgccagcgccattccgtcgtacgttgatgtcccgcggccgatttcatcaaacaggatcaggctgtcttttgtggcgttcacaatcgcgtttttcgcttccagcatttccaccataaaggtgctttgtccggaaatcaaatcatccgccgccccgattctcgtgaagatttgatcaaaaatcggcagaaccgcttcttttgcgggcacaaaacagccgatttgggccatgatcgatagaagtgcgatctgtctcatgtacgtgcttttacctgacatattcggacccgtaataaggagcatttcccgcgaatcgcccatcaggcagttgttcggcacgtattcttgactgtccatcaccttttcaacgacggggtgtctcccttcaatgacttttacttcattatcagaaaagacgggctttgtgtaatgcctgttttcactgatcgtagcaaagcattgcagcgcatccagctcactcatttgtttggcaagacgctgcagacgcggaataaattgtttcaccttttcacgcagaccggcaaaaagctcatattccagctcgcagatgttgttttccgcttctaaaataagcgcttctttttccttcaattccggcgtaatgtaccgttcggcgtttgtgagggtctgcttccgctcataccgcccgtcctcaagcagatgaaggtttgcttttgtgacttcaatataatagccgaacactttattgaaaccgacctttaatgaacggatgcccgtataagcgcgttcctgctgctccagtctggcaatccagtctttaccgtttttgctggcgtcacggtactcatcgagcttctgatgatagccgtctttaattaagttgccttcttttaacgataacggcgggttttcatgaagggcttcttctaacaggtcaagcaaatctccgcacggatcaatcaagccggcgcgttcttttgcttttttatggttaagagatcctacaagctctttaatgctcggcacttgttttaaagattctttcagctggattaaatctcttgcgttgacgtttccgaatgcgacccggcccgccagacgttctaaatcgtatacttccttcaggcgctcgcgcagatcttcgcgctcaaacagatgattgatcagcgtctcgaccatttcctggcgttcttcgatttgggatgccctgatcagcgggcggtcaatccattgtttgagaagccggccgcccatcgctgttttcgtctcgtctaaaagccaaagcaatgacccttttttgcttttcgaacggatcgtttccgtcagctcaagattccgttttgaatacaggtcaattttcatcgcttcttccaattcatatacttgaaccggctgcagatgatccaggctccgtttttgcgttttctgcaaatacgtatataaacgcataaacgtctctgtcagctcttcgcccggcaagtgctttgcgatttcaatgcgttctgttatttccccgtcttcgatagaaatcgttgcgccgcaccgttctttcagctgagcagccgtatgttcgttaaacttgcttgatacgacaatttcctttgcgccgactgagtaaatttctgacatgacatcttcaatccgctcaataaatacggccaggttttctccggtcgttaagtctgataaagcgagaccgtatccgttacgaaattcggaaacggaagcgataaagttgttttccgactcatggatgccttttccatccatcacggttcccggggtgatcagctggacgacttctctttttacaacgcctttagccgccttcggatcttccgtctgctcacagatcgccactttatagccctttttaatcagctgttcaatataagccgccgcggaatgatacggcacgccgcacatcggaattttatcagccgaacctccgtctctgcttgtcagtgtaatttcaagctcttgcgacgctttttttgcatcttcaaaaaacatttcataaaagtcaccaagccgaaaaaataaaaaggcatcttggtgctctgcctttatcttcaagtattgctgtatcataggcgtgtaactagccatcatttaatccctcactatgtatcttctcttatccgaatcccattataacataaacaaaagagtgatatctttatatataaaaaagagactcggggtgttaaactcccctagcctcaacttattcttcaggatctccgactaaaaattcagggttaatgtcctctaattcttcgtcaagatcgtcttcccaatcatcatcatcgtcttcttcccagtcaggattgacttcgacgacgactttcgtttcaccgaccacttctgctaaaaattccctctctgcctgaaccacgattttatttccgttaggagaaatggtgacttcaagacaattcggctgctgcagcactttggcaatgacttcgtgttcgtcatctaagtaatttgtatctctgtatctgagtttaatcacatcgacatactttactctctcggttacaacttccgtttttgtattatcggcgtaagagtaccagacgtttatatcataatacccttcaatttctacagtcttcccgatcttttcggcatcgtacttgtggttgataatccagccgcccagtatacttgacggtttttctccaggcgagatcgtgttggtgcattgggtgaattttcttcctttcgcaactaccgctttcgtaataatttccctgtattcagacattccggcaggcctccttgttcttcttcgtgttatcttatgctgggcatttgtctcatgtgcatttttataataaaaatataaaaatacaaagtttctgtttcattgtatgcagccctgcccagaaactttacttttaagtatgataaaactttccagtaaaaataggacaaaacgttgagacaatgaaaatttagtacatattacaattagttcttaaacggcaaaaaaaacacgggccgatgaaggccccgtgtttaaatagaacagctgttattcgaatgttttacttttgaaccggtttctcccgtcagcaggttgcctccggtagatgtaatgatttcgtttgtcacctgatttgagatcgtatgtgcgacaagctgaagaaggtcattgacctcaatctgggaatctctgaattcctggatgatcggaatcccttcaagctcttcctgcagggcgtcaattttactttccacttgtttcagcgcttcaagcttttcgtagtgcttcaggttaacggcttgcttttgcagggttttaatctgattaataatcgcagagactttttcattttcgttaatctgcgcctcggcgcgtttgaaaaaatcaacttcttctgtttcagaaatcattttcgcaaggttcctagcctgctgtacaatgtctttctttgagtaaagcgtcatcattatttcacctcgattgcttctcctgccatcacaccgtcaagcgaccatgttttcgcctgttcgattttgacgcgtacaatcttgccgatggcgtctttcggccctttgaagttgacgagcttgcttttttccgtatagccggcaagaatgtcagggttatttttgctttctccctcaactaatacttcgacagtcctgccttcatattccttcatttttttggctgaaatttctttcaccaaatcattaaggcgctgaagacgttctttcttgaccctcatcggaacattgtctttcatcttcgctgccggcgtgccttcacgaggagagtaaataaacgtatatgcgctgtcaaattccacttcgcgatataacgaaagcgtttcttcaaattgttcatccgtttcattcggaaaaccgacaataatatcggtcgtcagtgaagcgttcggcatcgccgctttaatttttccgacaagctccagatagcgttctctgtcatatttacgggccatcatttttaacatcgctgagcttcctgattgaaccggaagatggatatggtctaaaaggttgccgcctttggcgagcacttcgatcagatgatcatcaaagtcacgcggatgactcgtcgtgaatcggattctcggaatatcaattttacgcagttcgtccattaaatcaccgagaccgtacgtcatatcctcaaaatcttttccgtacgcattcacgttttgaccgagcagcgtgatttctttatagccttcgcttgcaagtcttctgacttcctggataatttcctcaggacggcggcttcgttcttttccgcgggtatacggtacgatgcagtatgtgcagaacttgtcgcagccgtacataatgttgacccagcctttaatttttccgttgcggactttcggaaggttctcaatgacatccccttctttcgaccacacttcaatgaccatctcttttgataaatatgcctctgataacagttccggcagacggtgaatgttgtgcgtgccgaaaatcatatcgacaaacgggtgcttcttaaggatgcggtttacgactgattcttcctgtgacatgcagccgcagacgccgagaatcaagtccgggttattttttttgagcgcctttaaatggccgagctctccgaacactttgttttcagcgttttcccggatggcgcaagtgtttaataaaataacgttcgcgtcatcaaccgaatttgtcgcttcataaccgagcgccataaaaatacccgccatgacttccgtatcatgctcgttcatttggcatccgtacgtgcggatataaaatttcctgccttcaccaaggcctttaaattcttcagagattttaaaatcgttatgatattgaacggattctttgccccgttttttcgcatcttttaaagaaggcggaatatatacggcttcaaaatacttgctgtaatccttttcggattttttgtccgccggattcacttgtccgctttcctgcttttgcttttcattcatgttcgaatgtctcctttcaaccgaaacttccaccctcaagtatactggttaaaagcgtttggcacaaccgccagcctattattgtacaccttattgagaataagaatcaataagaaataaaaaagagggaatcatttcccccttacacaagctgaagctcttttgcggctgaacggattacttccagggcccggtcaagctcctcttttgtatgctccgccgtaataatggtgcggattctcgcttttccttgggcgaccgtcggatacacgatgctttgtgcaaacacgccgcgggtcaataaaaggtctgataatgcctgggctttttcttcctcccctattaatatcggcacgatcggtgtttcgctttttgtgagggtcagccccatttgaaccagtttgtctttgaaatacgccgtgttctcccatagcttttccatatgctcaggctcttccagcaggacgtcaatggcttctatgcatgcggccgttactgcaggcggatgagaagtgctgaataagaaaggacgccctttatggcgcaggtaatcgatcagaacctgcgaccctgcggcgtaaccgccaagcactccgatggctttgcttaatgtgcccacctgtatgtggactcttccgtcaagcccgaagtgattaaccgtcccccttccgttttttccgagtacgccggaagcatgcgcatcgtcgaccatcacaaaggcatcgtacgcctctgcaagtttgacgatgtcaggcaaaggagcgatgttgccgtccattgagaatacgccgtcggtgacgatcaggcgcatgcggtaattcattgattttttcagcaccctttccaaatcgtccatatcaacatggcggtacacctttttatctgcttttgtcagcctgatcccgtcaataatggaagcatggttcagttcgtcagagatcacgatatcttcttttgtaagaatgcttgataagacgccctgattcgttgtgaaccccgattgaaaaacaagtgccgcttctgtttttttaaaggttgccaattttttctccagctcattgtgcattgtgaatgttccggcgattgtacggacggaccccgtacccgctccgaattcttccgcggcgcgtttggccgcttcgacaagtcttggatgcgacgtcaaaccgagataattgttcgatgaaagctgtatcacgttttcccctttgacttccaccgacggaccctgcttcgtttcaatttgtttcatttgctgccacgttttattttctttcattttatcaagctctgcttttagaaattcaaattctttcattatagaaccctccccttatggaatcaaaatgactttgccgcactgtccctttctcatcaggtcaaaccctttttcaaagtcttcaagcggaaactgatgcgtgatcaccggcgtcagatcaacaaggccggattcaagcaggtgcgatacctgccgccatgtttcaaacatttttctgcctgtgatgccttggacggtaagtcctttaaacaccacgtcatttgtcaggtcaaccgtcaccggacgttccggcagactcagcatgtggaaccttcccccgttggccgccatctttaatccttgtgttatggctgccgggtggcctgacatttcgcagacaaggtcgatcccttcaccgcctgttaaggtgtcgatcacctcaagcggatcttcctcatcaactgaaatggtgatcgcagctcccaatttcttcgcaagagccagcctgtaatcatttttatcaatggccgcaatacgggatgcaccggccgctttagccaccgccaccgccatcagcccgatcggtccgcagccgataattgcagcggaaccgcccgcaagccggctgctttccagcaccgtatgcaccgcgttgccaagcggctcttgaacagaggcgacggcggggtccatatcagcggggtttttccaaacatttcgggccggcactttgacatattcagcgaaggagccggctgtatctacgccgaggatctttgtatgggtgcacacatgatgtttttctgttaaacacgggacacaagtaccgcagacgaagtgggtttcagccgaaacgtagtcacctattttgacatttgtgacgtgcttgcccgtttccgctacgataccgctgaattcatgtccgaatacttgaggtgttttgattcgtttctgcgcccattgatcccaattataaatatgcacatctgtaccgcatatagatgcggcctgtactttaatgagaacttcattctcattaatggaaggtatgggaatttctttcagcgttgctccgaaagcgttttcatttttaacgatagctttcatctttcctcccaacatgtacactcctcctcgaaaaaacactgtaataactggattgtaacatgagataaaaaggaggtaaacaccagtgtccactcgaggaaaacaactgcttccgtccggaaaaatgggcgggattttttttgaatattatatgaataaagccatttatcatctcttcgtactatcaatataatattgtgagaaaatatgacagcaataaaaacaacctgctcgccttacgcaagcaggttgagaatgtacatatttttgtttttaacggggttcgacgattaacttaatcgccgttctttcttctccgtcaatctgtatatctgtaaaagccggaatacaaatcaaatctacgccgcttggcgcgacaaagcctctggcaatcgcaaccgctttaacagcctggtttaaggcacccgccccaattgcttgaatttcggcggctccgcgttctctcaatacgccggcaagcgcgcctgctactgaatttggacttgattttgctgaaacttttaagatttccatttctgctcccccttagttttacaatggataagtgagtgttcattagaacaatcattattagatgttgctatccaaaaagccatccccacaatgcttttcaaaaatagcgggctaccttccatttctactatattcactaagaagttgctatattcctgcttttccttttaatatttttataaaataaacacatgatcacctattcaaagaacatatggtcatcattgattaatatccgttcgatatttacggcctttttcgtttgatcgtcgatgtcaatgagcactccgctcagcgtagttttaccttccgccaccgtaaaccggacgggaagattggttttaaaccgcttgatgaccgtttctctgtccataccgagaattccgtcgtacggacccgtcatgcctacatcagtaatatatgccgttcctttcggcaaaatgcggttatctgccgtttgcacgtgtgtatgggtgcctaccacggcagaggctcttccgtctgtataccagccgatcgcaattttttcgcttgtcgcttccgcgtgaaaatcaataaaaatgtacggtgtgcgctttttcgcttcttctattaattcatccgctttagcaaacggatcatcaagcggcggaagaaacgtccgcccctgtaaattaatgacggcaagctcttttccgttcgatttaatataagtaatgcctttgcccggcgtaccttccgggaaattcgccggccggacaagatgcggcacatcatcaataaagtcgaagatctctcttttatcccacgtatggtttcccattgtaatggcgtcggctcccgcttccatcaggctgtggtagatcttttccgtcagtccttttccgtgtgctgcattttctccgttaataattgtaaaatgcggtttatgtttcgctttcagtttcgggacatattcttttaccatgtcgcggcccggggaaccgacaacatctccgataaataaaattctcatacattccattccttccttttcagggactcaaaaaaataaagtgatgcgctaagcatcactttattttgcatactctacggctcgagtttctctgatcacggtcactttaatgtgtcccggataatcaagctcgtcctcaattcgtttacggatatcacgcgccaaacgatgggcttctaaatcattaatggagtccggcttcaccatgatgcgaacttcacggccggcctgaatcgcaaatgatttttcaacaccttcgtaagactcggagatttcttcaagcttttcaagtctgcggatatagttttcgagcgtttcacttctcgcgcccggtcttgcggctgacagtgcatcagcggcagcaaccagaacggcgataatggaagtcggctcttcgtctccgtggtgtgacgcaatactgttaatgacgactggatgctctttatatttggtcgcaagctccactccgatttccacgtggcttccttccacttcatggtcaattgcttttccgatgtcatgcagaagaccggcacgcttggcaagctttgcatcttctccaagctcggaagccattaaaccggctaaaaacgcaacttccatagaatgtttcagtacgttctgcccgtagcttgtacggaatttcaaccggccgaggatcttgatcagatccgggtgaagtccgtgaacgccgacttcaaacgtcgtctgctcacccatttcccggatatagtcatcaacctcacggcgggatttttcaaccatttcttcaatgcgcgccggatgaatacggccatcctgaacgagtttatcaagagcgattcttgccgtctcccgtctgatcggatcaaatccggaaagaatgactgcttcaggtgtgtcatcaataatcaggtcaatacctgtaagcgtttcaagcgtacgaatgttacgcccttcacggccgatgatacgtcctttcatctcatcattcggaagattgacgaccgataccgtcgtttcggcaacatgatctgctgcacagcgctgcaaagcaagcgacagaatgtttttcgcctttttatctgcctcttctttcgcacggttttcggtttcttttgtcatgatggcgatgtcatgtgaaagctcattttcaacccggtcaagaatgatttgtttcgcttcatcccgtgtcaggctcgaaatgcgttcgagttctgactgctgcatacgaatcatctcatccactttgctttccatctcttcaatatgttgttgtcgttcattcagagaatgatctttcttctccaacatcgcttcccgtttatcaattccttcatgtttacggtcaagattttcttctttttgaagtaaacggttttcttgtttttgaagctcatttcgtctttcacgaacttcctgttcagcatctattcgaagtgtatggatttcgtcctttgcttcaagcagagcttcttttttcagtgcttcagcatcacgctttgcatcttcaaggatttgctcggcagcaccgcgtgcgcccgcaatctttgcttcggcaatggttttacgaacatagtagccaacaactaaaccgagcagagtcagcaaaatggagatgagaaccgtcattggggtcatactttcacctcctcttgctatgaacttggtttttgcttaaataagtgccggcatgtacattgtctgattttctcaacatacagaaccttcacagggaatgagtctctcatgcccttgtcaagtttaaatggtttaacaatcatgttaaaaaaacaaatgttacaacttcattgtaattgtgtcggaaatacttgtcaagcttgccagcttaacgattcgccttcagctcggatcgccgcccatgtatatatcataccataccttcatccgcttttcgtgaatgacggctctgtcagtccgcctggttaagcaattggtaaattctattgtttacctgtcctaatttggcgttattctgaatgtttgacagtaatatgacatatttgcttgccgaatggctgaaactgtttaaaatgttgtaaccgggcataacaccgtgattggaatagctgcccggatcaatgtaaaaccccatcccgtaagcggcactgcttcctgctgtaaacatttttgtgaagctttcttttgaaaggagcgtgccgtttacgatcgctttatcaaatttataaagatcttcagcgctcatatacatgtcgcccgccccgtaaagctgcgataagtccaaaaggtgcggcgttacaagactgccgctctcatcgactttgtagccgacggcaggatatttggcttcagcaaatgttttgtaaaatccggcatgcttcattccggccggtttgaacacgtgttcttttatatattgttcataagactccccgctgacctgagatgcgatataagcaagcactgaatagttggaatccctgtaatcccaaaccccgggctgccttttaattccgcggtattctatatccttgattaaatcaattggagaaatcggtccccgaccctcaatatgcccgtttatgccggacgtatgattgagcaggtttttcaatgtgatgcgcgtgccgttaggaaaattcggcaagtatgtactgacggggtcactcgtctgcagcagccctttttcttcaagctgcaggacagccgtcgcgattaacgctttttgtgaagaaccgatataatatgatgtctccggattgtttttaattttttgttttcggtctgcatagccaaagccttttttcagcacaacttttccatcttttacgatcattgctgtgccgctgaacccgatctgttgcaagtaattgctgatctgtttattgtgatcgattgatttaggtgttttctctttttgcgtcttttcttttttctgttgagtctggtcttttgaagtatcagattgagcggcgggagcgtttttaacggattccttctcccgatgatgcgctgtgacggtccagatcataataaaaacagtgacaagcagcagaaaaagaaacagccctcccgttttcatcagcttcttctttctttttttatttattcttgtgcggcgggggctcgtcatcttttttcctcctcagatataatttcaactttcgccatgatgttagacgagtgaagggtgaaaaaagttgtaacattccagataaaattttccgaaacagccagtgtttttttgaaacatacaaaaaaaagagcggaaattgcttattccgctcttttgatcgtgtttttattcttctaattccatctcttcctgaacttcttccgctttgtccgttacaccgttattgtctaaaccgtaatattcacggatttgttcctgaatcatcagcatgatgtctttattttcttttaagaactgcttggcgttttcacggccctgaccgaggcgttcttcttcataagaataccacgaaccgcttttttgcacgatatccagttcagttccaaggtcgatgatttccccttctttggagattccttcaccgtacataatgtccacttcagccgtacggaacggaggagcgactttgttttttacgactttaattctcgttttattccccatcacgtcgttgccctgctttaattgctcggcacggcgcacttcaagacgcacggaagaatagaatttcagcgcgcggccgcccggtgtcgtctccggatttccgaacataacgccgactttttcacgaatctggttaataaagattgcgattgttttagatttattgatggcgccggaaagcttacggagcgcctgagacataagacgcgcctgtaaaccgacgtgtgaatcacccatgtcaccttcaatttcagcttttggaacaagcgccgcaacagagtcaacgactacgatatcaacagctccgcttcgcaccagcgcttcagcaatctcaagcgcctgctcccccgtatccggctgagaaagcagaagctcttcgatattgacaccgagcttttgcgcgtaaacaggatcaagagcatgctcagcatcaataaatgctgcctgtccgcctttttcctgaacctcagcgattgcgtgaagcgctacagtcgttttacctgaactttcaggtccgtatacttcaataatccgtccgcgcgggtatccgcctattccgagagcagtatcaagtgcaagggagccgcttggcaccgttgaaattcttgtatccgttttttctccgagcttcatgatggaacctttgccgaattgtttttctatttgcttaagagccatatctaaggctgcctgacgatcactcatttattttttcctcctttatcttgccactacatatactataccttgtttactggcatttgccaagaaaaaagcgaacgcatattcggattttttccgcgttcgcttttctgcaaaagagcataatttcccttatgaaacttaaaaatcagagaaaaaagctctttaaaactttatttttgatccagcatttttaaaatgagatggcagccgtatttagcggcgcgctttctgattccggttcttgagccggcaaagtgaaattcgtgcacctcttcttttccttccgctgaaatgccgataaagacgcggcccggcgcatgcccttcctgcgggtcgggacccgcgaccccggtaaagctgatgccgatatcgcttccggtcagctttctcacaccggatgcaagctctttcgcacactctttgctgaccgctccgctttctgcgagcgtctcagctttcacgccgagcacatgctgtttcacgctgtcggaatagcagacaacacctcctgcaaatagttgagacgcaccgcttaaatcagtcacccactctgaaaacaagccgcctgtaaagctttcggcagaagaaatcgtgattttgttttgtctgcatgcttttgaaagctccttcaccagggacgtatcatcatatccgtagaaaaattcaccgacacgttctaaaatggcggcttccgtttcttttaaaagccgttctgtttctttttcgtcagcatgtttcgccgttaaacgcagcgtgacctcgccgtcagcagcaagcggcgcaatcgtcggattcgtctgcgcgtcaatgatatcttctaaatcagcttcaagctgggattcaccgattccgaaaaaccgcagcacggttgaaacgattttctcattagaaccaagctttttaagaagcagcggtttcgcttcattttcaaacatcggacgcagctcgctcggcggcccgggaagcagcatataaagccttgagccgtgctctgcaagcattcccggcgccatgccgaaatgattcgccaaaacgtccgagccctcaatgacgagcgcctgtttgcggttattcggcgacatggtccgttttgttttcgcgaaatattcttcgatcgaccggaacgcttcgtcattcagaacgagcgggcgccccagtgtgtttgcaatggtttctttcgtcaaatcgtccttggtcggtccgaggccgcctgaaaaaataatcaggtctgagcgctcttcggcaatgcggatgacttgcttaagccgctccggattgtcaccgacagcggtatggtaaaacacgtttacaccgatttccgccagttctttactgataaactgcgcgttcgtattggcgatctggccgagcagaagctccgagccgaccgcaatgatttctgctttttttgctatttccatctttaagtccttcttccttagttagatgtttttaacgcatcccagttcttcgcaaaataatcccagccggaaatgactgtgaagagcacggccacccataaagcgatatcgccgaacgggaaagaaacgagctcaaacggaagattatgcagcaaaagcgcggcaacagcgatgatctgggcccatgttttaattttccccagcatattggcggctacaacttcccccgttcccgccagcacaagtcttaatcccgttacggcaaattcgcggctgatgatgatgatgaccatccacgccggcgcaaggtcaaattgcacaagcgtaattaatgccgcggacaccagcagtttgtcagccagcggatctaaaaatttcccgaagtttgtcacgaggttcagttttctggcgtagtagccatccacccagtcagtcgttgatgcgataatgaacaaaacagctcccgtaagatgcgcgaccggaatcgattcatcccctatatgaacgctgccccaatgaaaaggaacaagcatgataatcataaatacaggaattaaagcgattcttgccagtgtgattttattcggtaagttaaacataaagcccctccaataatatgtactcggacgtgaagaaaaagtcatcttaatcgttcagatgactttttccccttttattttttcatcttgattgtgatggtctgcgccatcatatcatgcggattgagttcataggacagaacctctccgttgattttaattttcaggttaggggcatagcccgtgcggatttcaatctgcttttgatccgtgacgtcttttttaaaggtttcgcctttttgcagcgttccttcttttaaagaaccgccgctgtcatcacggacgcggatccatgcgctgtcagaagcaatcagttcaagcttatacttatctgccccggagacgttgtatgaagaagccgagccttccgttccggccgctttgatctccgtcttttcactgcttttttctttctttttctgctctgacgcttttgtgtcttttttgctgtcagattgcgcttcgtcgtttgtattgccgtcgtttttcagcgcagaatccttaggaatctcatacttgctctcactttgggtgacggccttatctccgtctgtctgcccggatttgctcattccgaactgaataatcgcataaatgatcgcgatgacgataatgacaccgatgacgacaaggacggtcggaagccattccgccgcctttgaagcggacttaggaagctccctttgcatggcgagaccggagattttttccgacacatcgtcatggtacgtgttagggatgtcttttttatattcttcgaataactgatctgaatcaagcccgacagcttcagcgtactgcttgataaacgcccgcacataaaaattgccgggaatgacgtcataattgccttcttccagagcggttaagtatcttttctgaattttcgtcgccgcctggagttcatccaatgacatccctttttcctctctggcttctttaagccggattgctaattctgtcacaacaaacaccttccaatattaaaaatcaaagcttgaaaaaccggtctggtcaaacatttgcggttcttctgcatgttcatatgtaatgacttcgtcaggatcatttctgagttcgataatataatcgaaatcatcgagcgtatactccgaattttgaacaaaaatatcggggtgctccacgacctttgtcgccggaagccgcataatttcactgacgagctgaagatggcgctcagatccccgtcttgtcgaaacgatgccgtcgaggataaacacgttttccgtgctgtattcatcggcaaccagctggctccggatcgtttgttttagcagcgttgatgatacgaaaagccatcttttgctggcacaaacgcttgacgcaacgatggactccgtctttccgaccctcggcattccccggattccgatcagtttgtgcccttcttttttaaacagctcggccataaagtcaaccagaagaccgagctcgtccctttcaaaacggaaggtttttttgtcatcggcatcacgctgaatgtatcttccgtggcggactgcgagacggtcgcgaagcctcggttctctcaacttcgttactttaatggtctccattgtttttaaaattgattccaatcgtttaatttgatctatatgccggcatctgagcagcattccccttctggaaaggtcgacaccgttaattgtgacaatattaattgacagcatcccgagaagagatgaaatatccccgagcaggccggggcggttcacttgaatttcatattcaaaataccattcgagctttgccaaatgatataccccctccattgtggcaaatttttaccttcctttatcataaaacatttttctctaattagaaagaagaatgttgctctatagaggaaaacataaaaaaagagaggagaaatcccccctcttaatgagtgctgttattttcaacaagcttcaccatcatatttgcgatggcgcgctgttcatcttcagaagcaacgctccaaagatcagcaagcactttttcctgatggtttttcgagtcgacttcgttcgcaaggtaaccgccgatttctgtcgcgaggtcagtgatcgtttcatcactcatccctttttcctgcgcatagttcaatctgtcgccaaggaaattcttccaattatcccagttttctaatactgacatgttgggttcctccatttcatctgttgttacaaaattattttgtccgtgcagatgcaaactatacacacatttttttcagcagtgccagccgccgtttacggataatatatgccccgtaatataggaagccttgtccgataataaaaaggccgccgcttcggcgatttcctccggcttcgccagccggcccgcgggaatttcctctgccaacgcttctttttcatcagacgtgaactgatcaagcatatttgtatcaacggcacccggcgagaccgcattcacgcggacgccgctcggagcgagctctttggcaagcgctttgacgaacgaatgctgcgctcctttgaccatgctgtataatacctcgcacgatgcacctgtttctccccagacggaaccgatcgcgacaatgcccccgctttttttccggatcatgccgggcaccagattacgcgccaaaagaaacggactcgtcacatgcagctgcaccatctcccgcgccgtgtcatccgtaacgtccgtaatcaggccgaaatgacttttgccgctgtttaatatcagagcgtccacaggctgcttaacggaacggctgagtgtctccgcgccatccggtgaggacagatcagcctggatagcggaggcttttacgccgaatgatgcgctcagcctttccgcaagcctgtgtgcggcttccttattagaatgataatgcaaaaggacgtcatatccgttttttgcgaggacttcacttatactttgtccgattccgccgcttgctccggttacgagcgctgtctgtttcatcaatcaatactccttctttccccagaaaaacatccctcagggcgtgagggatgttttgttatgattttggcacgactttgcagactgtcagcctgtcttctgatatttcttctttaatgacccgctttacgtcttccagggtgatctgctccagtacggttacgacatcaaacagactcatatctaaaaaggcgtagcgtgtgaattggttggcgatgtattcaggcgaattgagcgcttttaaaaatgacccgatcttcttttttctcgcaaggtcaagtttttccgcagttacggctgattctgcatcaagcagcatctgttttaattcgtcagcgagcttatccggctctggtgtatctcctccgacagaggcaaagccgaatccgtattcagccgtgtaatcaaagctgaaggtttcatcaatgtagcctttatcgtacaagttgccgtaatgcggtgagctttttccgaagagacattcaagcatgaggttcatgctgagctcgtgcttcaacagctcccgccccgttttataagggtctttcgcctttaaaccgacaagacattttgagccttgcacgttcatttttaattcctgctcccggcggaaaaccgcttcctgctcctgaacctctttacgtttgatttcaggctggtctgtaaacggctttttctcctggtttttccgcacctggctgatgatcgcttcaggatctgcggggccgacgataaagagcagcatattgctcggatgataaaacgtttcgtagcactcatacagcagatctttcgtaatatgagagatgctctccaccgttccggcaatgtcaatttttacggggtggtctttatacatattttcgataaggccgaaaaacagccgccaatccggattatcatcatacatattgatttcctggccgatgatgcctttttctttttcaactgatttttccgtgaaatacgggtcctgaacaaaatcaacgagtgtttccaggtttttctctacattagaagtgctggagaacagataagcggttcgtgtaaatgatgtaaaggcatttgccgacgccccctgcttactgaagtcctgaaacacgtcgccgtccgctttttcaaacagtttatgttccagaaaatgcgcgattccgtcaggcacgtgtaccatttcttccttatttaaaggaacgaattgattgtcaatggaaccgtactttgtcgtaaacacggcgtatgttttattaaaaccctgtttcggcagcacatagacatcaaggccgtttgccattttttcatgatacagcgtttcctgaagctgttcgaaatttatcggtttagtcaagatgctccccccgtcccttttaagaaataagtcgtatccagcttaatgttctttccgacattgataatgtcctcttttgtcactttctcgatattgtcgaggaaagtttcgatcggtatttccacttgggctgaagcctgctgatacagaaattccgctaagccgtatgccgtatcaatcgtttctaacacttggtttttaataacggctttcgtttgggcgatatcgtcctctgaaaagtcaccgttttgcatagcctgaaattgttcttcgataatggtgacggcctgcttataatttttcacctcaatgcccgacatgaccatcaaaagccctttgaagctttccacccttgaggctgcataataggcgaggcttgctttttcacggacatttataaacagctttgaatgagagaaacccccgaacagcccgttaaacacctgcaatgccggataatccggatctgtatatgtcgtattggtccggaatccgatattcagcttgccctgcttgacgtcctcttcatcaatgacttccttcggatcgggctgttcattcgtcttgcttctttcaaaaggctgcagctcccgttcttccgttttaaaatacgtatcaacggccgttttcacctgatctgaatcaacatcgccgatgacgtacaggtccagctgatcttcgcgtatggctttttgataggcttcatacaactcttgcggtgtaatgtgttcgacatcatcgaactcgccgttgacgtgaagggcatacggttcgcttttgcacatttcctgaacgagacgcagattagaatatctcatcttatcatcatatacggcttgaatccgctgtttcagcgtccgtttttcctgcgtgacataaaggggcaggaaggcgccgttttccaaagcgggcgaaaagacaagctctgataaaagctgaaggcctttttccaataacggtgtgcggtccttcagatacttttcgttaggaatctcaagtctgaacgtaatgacatgacgttctcccttttttgtcagatcagctgaaacggatgtgccgtacagctcatcaaaataagaacgcagatcagcggttttcgggcggctttctgttccgcgcagaagcacatgcggaaacagcgccctttttgttacgagctctttcgttaaaggagccagcattttaaacgtcagcgaaacggttttaaatttctcagtctttacgatgtgggcggtgatcccgccgtgctttgacttcatttcatttacgtaagtcatgtgaaacctccttcgttcattctttaatagtatgtattatggccaaatttcaggattcgcaaaaaagagtgcgcagatgtaattatatcaactggaggatttataaggaaacaaaaaacctctgcccgaaaacaggcagaggcattgaacgttattttttcaaattgaaaggccaccagttggctcttccgaatattttcaccatgaccggcacaaaaaacggaaggacgacaattgcgtacatgagaaggcctgttaataccacggttgcaatctgtaataaggaaagaacgcctgacggcagcatggccgcaaaggttcccgctaaaataatcgccgcagaaatgatgacggaacccatatttttcatactgctgatcattgcgggttccgttccttcttttttcagctcattaaagcggtccattaaaaagatggaataatccacaccaagagccatcaaaatgacaaagccgaagaacggcacggcccagtttacgcccggatacccgaagaagtgtgtaaagatgtattccgtcacgccgatggatgcgaaatacgtcagtacgagcgacgccactaaataaacaggcataataagagagcgcagcattatgatgagaatcagaaaaattcccgccagcataaacattgccgtccgtttgaagtctgaatccgatacttctttcagatcggcattcatgctggagactcccgaaacgccgaaagaggcattcttcagatccgtgttcggaatggctctttttacgctcgctttgatcgcttgaatatcttgaatggccgtatttgagtaaggattgttatcaagaacgacggtcaattctgtcgtttttctgtcatctgacatgtacgtattaaacacgcttgtgaaatcactgtttgtcaacgcgtctttcggcacaaaccagcctgtcatttctttatctgaggccttgtgaagctcacccaggtaatcattcgcccccatcatgccgcttgatactttcttaagcccttttacactatcgttaaggcctgaagaaagatcgctgagccgggaagaaaaatcaccgagaccgctcttcatttttttctggccctccgcgagctgtcctgccgccgattcaaggcgcggcatttgtcctgcaagagccccctgtccgtctgacacttgctgcagaccgttttcaatactggtcagaccggtgatcattgcgttaatttgagtgtcgatctttttttgagcggctgccagccgggcaaattgtttttccgcttgctgcagatgatccttttgactgtcgacctgtttagaaaacgcttctgcatccgcgtttgccttggaaacggctgactgtacacccgtaaaggccgatttgatttctttgtaagagggatcggttttgactgacggtattgacgcttccaattttgcaaacggcagccgggcaagctgcttgttcaaatcggcaagctgtctgctggtttcatctttcatcggcaggacggtttttaccaattttaaagcgttttgcgtttctgaagcgagaccgctgttttgtttgagctgtgaagtcagcatttgtttttgctcttcaatctgctttctcatctgggcgacgccggctttattctcattcacgcctgcctgcagtttattcaggttttcgcctatatcagaaagcccggatttcagagacaatgttccgttaataagctgattgacgcttttccccgactcttcgatctgcggctgtgaatcagctaacgactttgcggcatgccctaatccgtccgtgattttttcaagtcctgtattgcctttatcaagcccttcttgaagctgctttgcctgatttgtgacaaataattgattcaatccgtttccggcagggcgcgtggcgcttctgaccgtttttacaccctctgttttttcaagttctctgctgattttttcgatatcaatcaggtgtttttcggtatttagaggctcatcatttttgatgacgactgtggccggaagaagctcccccgggccgaatgcgtctgaaatcgtattaaacgcgcggacggattcatatttatccccgatttcgtcaaggctgttgtaagatagcgatcctttgtaaagaaggatcggcgggacggtgaataccgcaacgattgcaagactgatgagcggccttttaaatgaaaaccgccctgccgtttcccatgctttactttgaggatgggaaatatcacccttaacgggccaaaacagtctttttcctaaaacagccataaaaaacggcacgatcgtcatgagcgcaagcagcagcaccgcgacaccgactgcaacggcggctgccgactgatacagcttaaatgtcgcaaacccgatgcaggcaaatccgatcagcaccgcaccgccgctgtacaaaaccgtctttccggccgttttgtaggtgacgacgatcgcctctcttatatcagcgccatgcgacagttcttctttaaatctgctgagaagcagaatgcagtagtctgtgccgattccgaacataatcgcaaccatgaaaatctgcgtaaaagttgagagcggaaaattcagctggtcgactaaaaatgcgacaatcgactggctgactaaataagatatcaatacagataaaagcggcacaaacggagcgaccactgaccggaatacaaggatcagcacgatcaggataaaagcgaccgttatatattcagtctttttcaatccgtcctgtgagctttttaacacatcttcatcgatcagcgactggcctgtaatgccgtatgatacgccgtacggtttcagctctttatcaattttatttttgatttcgaggatatcgtttttggatgtatcaagctgcagctgaacgagcatcgtttgtctgtcttttgacagcagctgttttttgatgtcgtcatttttctccccgaagtatgaagtcaccgttttaatctgaagcgcttttttctgttcagacaaagtgctgacggcttcttccagacgatcttttttgtctgtcattaagcctttttcgtgaaatacgatgacggcagaagaagacggtgcatctgaatcagacatttcatcaagcaattcatgggcataagaagaggaatatccgtccggtacggaaatctgccctttctcccgtgtcaattcagccatatcaggcgctgtaagcataaatatcaccgttgcggcgatccataccgcggcgatgatccagcgggctcggataatgtttttcattatgtctgctgatcctcctctgtcatcatcaatcgatataatttttcatatgtattaacgaacatctccgcctcgtcttcatcaaaatacataatatatgaacggacgagttcctcaatccgccgctccacacggtgaaatacttccgtccccttttccgtgacatttaaaagtatgctccggcggtcgctttggctgcgttctctattgatgtagcctttttcatacaggcggttcgtcatcgatgtaatggcgcttttgttgacgtggcacaccgcggccagttcaattgatttgcaatccggattgagcataatatagcggagtatgtaatattgatccaatgtcagctctttgttcactttttcagcgataatgctgtcaattttttttaagacgtgcaggtatacatcggaataacgctgaatcagctgctttactttttcttcatgcatcttttccccctccttccaatagttaaaatgtttaactattaaaaaggataacgacttgacgatatcatgtcaatcttcaaaataaaataaaaaaagacagtgcagattacaccgtctttaatgattcctttttttcttttgcttgtgatgagatatttaacagcgctaaaaatacagacacaatgccgcaaaaagcggataaaataaaaatcagccagcctgcatttgacatcagggcagcaaagatcggcggtcccgcagctactccgataaaccgcatgctgttataaaatgaggtgatggttcccgattcctcgttgtctacgccttctgtgatgacagcgtctaatgccggtaatgctattccgataccgataccgctgacacacaaaaagataaataataaataaaaactgtgattccaccataggccgataaacgacagtgtcacggcactcattccgaaaacgatgcagaacttcattttgccttggtctttcccgatttttctgcctgatatatatgaactgacggatagaaataaaagcgggattgccaaaagcgctcctttagccacaccgtcaattccgtatttcttctccagtgagtctgataaataaaaaagaaccccgaacagcaaaaacataatcacgcagccgatgataaataccgtaaagagccagcgtccgtcacgcttaaatatgcggccgacattttttacaaattcggaaatagaaggggcttctttttgtttctccggctttgccaccaaaaacaatacgagaaaaaaactgataagcgaaaaaaacggaatgaaccaaaacggcataaaccaaaaccatgcagccaagagcgacccgagaatcgggcttaatactttcccggccgtgtttgacgtctcaatgtcgccgagccccgcggtaatccgctcatcatcccctttgaataaatcaccgataaacggcatcactacaggagccgcccctgccgaaccgattccctgcagcacccgccccgccaagataatgggataaggatgcttgaacgcggtggaagctatcgcggcaagcgctccgcccgcaccggctatgagaagacaaggcagaagaaccttttttcttccgaatttatcggacaaatatccggcaatcggaatacaaataatcgccacaatcgaatagaccgttataattaacgatacttgaaaagacgatatggacagcttcttttcaatcatcggaagcacaggaatcagcatggaattcccgagtgtcatcacgagcggtacagaagccagagcaatgatattttttgttccatttttcttcttactcaacttattcacccattcactatacttggttgtttcctgttttattgtgccttgcggaaaacaaagtatgtattgaagcggcaaataaaaaaacagacacatgacgcgtctgtcttaaaaacgttttcttacaacatgaaaactgaacttatcagcccggaaataatttaatgaatacagcacaggttcatcattctgattatagtgggtttgcttcagcaataaaagcgccgtctccggctcgcactccaaaaccggtgaaatcgtatcgtgatatccgatcggttcgatatcggcaacggcatagctgatcacagacccggagtttttttccaaaagatcaaaaatagattcctgttcatgacagaaagaattcggcagaatgtgcatcggaatcgtatctaaacagtaaacgaccggagtgccgcttgccgttctcacgcgttccaaataaaaaagctcctgctcaggctcaagccggaatctagcgatatcttcctcagacggcgtgatgacctgagacgacaaaaaaatcgtacccggcaccatgttcgcctgctgaatcattttcgtcacgctgttgagctgttcaatacctgaaagaaacagcggttttgtatggacgaaagtgcccacaccgtgccttctgataatcacatgctcctcttcaaggatacgcaaagcttcacgcagagttgcccggctgacacccatagattttgaaagctcaaattcagaaggaagcttttccttttcggtgtaaattccgttttgtatatcctctttgattcgctcaatcacttttaggtacaagtgacgattgtcagcttttgtagacatgtttcccctccgtaaaccactttcataaattattgaacaattgggacaactatatcatgttttaataaaaaaataaataggaatgattttggtgatatcattttcagtgaaaactctctcctttttaagaagagagctcatcatattgttccttagataatagtacttccctcggtttgcttccttcatacggcccgacgacgccccgttcctccattgcgtcaatcagacgggcagctctcgtatatccgattctgaaccgcctttgaagcatggagactgatgccgtctgcatgccgataatcaaatcgaccgcttcgtcatagagatcatccgttacttcactgtgtgtttccgacacttcttccggaatcatctcttcttgatactgcgctttttgctgcgtaatcacatgatcgacgacatgctcaacctcttcatccgataaaaatgctccctggacccggacaggcttattcgcgcctacaggcagaaacagcatgtctccgcgccccagaagcttttcagcgccgcccatgtctaaaatggtccgtgaatcggtctgagatgagacgctgaaggcaattcttgacggaatgttggctttaataacaccggtaatgacatcgactgaaggccgctgtgtcgcgataatcaaatgaattcccgccgcccgcgccatctgtgaaagtctcgtaattgaatcttccacgtcggaagaagcgaccatcatcagatcggcaagctcgtcaacaatgacgacgatgtacggcagctcaggctgcttgacttcttcttcggcatttgaccgcttaatatggtcgttatagccttctatatttctcgtacccgtatgggagaacagctcatagcggcgctccatctcattgacgacctttttcaaagcctgcgaggcctttttcggatctgtcacgaccggcgcaagcagatgaggaatgccgttatacacattcagctcaaccattttcgggtcaatcatcatcatcttcacttcatgcggtttggccctcatcagaatgctcgtaataataccgttgacacagacgctttttccgcttcccgttgcccccgctacgagcaggtggggcattttgttcagttcggcaagcacggcttccccggaaatatttcgtcccaagccgatcagaagcttcgcgtccggcttgtcattgagcttggattcaagcacttcttttaacgaaaccatcgcaacttcagcattgggcacctcgatgccgattgctgatttgcccggaatcggcgcttctatccggatatccttggcggcaagcgcgagcgcgaggtcatcgctcagattcacgattttactgactttgaccccgacgtccggatacacctcatattttgtgaccgccgggccgagatgaacttgggtcactttcgcctttaccccgaagctttgaaaggtccgttcgagttttcttgcattctcgtaaatgtttttcttatcggtctgctggccggtatgtttcgggtcagccaggatgtccaatgaaggcatttgataatctttattttcaagctctgtaaacgtcatcggcggagccgcagccgtttcgtcactgtcttgagcgccgccggaaggctcatcttttgccgtttgcgccgtctcctgcgttttttccggaatcagcggttcgacgcgttcttcctgacggtctgaaaagcttgaaataatcggctctgaatggatgatcggcgaaatgatttcctcatcctcttcttcgggctcaggcatttcttttttcttctgaacccgtttttgttttttgcccgatttggtttttgttttcggcgaagacatattcgttctgaccgttttcatatcctcaagaaatgcctgccattgaccgcggataaaccggccgacggggctcgtccactttttgagcgtttcctgcagtgaacgccccgttacaagaatcagccccattaagatcagcacgatcgccatgatctgtgaacccgttgatgcaaataaaaagtgggaagctgcaaacagcaccgcgccgatcatgccgccgcccaaatcaggggaagcagcctgctgtttcatgtcaatcataaacagctcccacgtgttgccgatgacacttgccgaccgaatcgacccgtgatgagacagatttttaaagagctgcacgtgagacagcagcaaaatactggcgataatacagtacaaccctgcctttctcctcgttaaaaggcttggactcttctttttccaaaacagcgaaattccgagaaggaagagcgcaattaagcataaaataaaccactctccggcaaaaaaacggaacaagtacacaaatgtctgtcccacaacgccgagctgcaaaacagcaataatcgagattgcaacacagagcagtccgcttagttcgtattttagattgagcttactctcttgtttctttttagatttccgttttttctttgccacactcatcaccttactgcgttaaaaaatgtaaaatcatacatcatgaagaaaagcagccttttgccggctgcatttttctgtaggattcccctattatagcatattttgcccccgagaaacggactgaatgccggttagattttcagcttgattttttgtcccggagcgatgtccggattcagaaaatccatcgggttcgtacttaaaatctgtacgacttcagcttcatttcccttcatctcaaccagcagcggcacgccggcgtaatctacctgttcatgcacgctttgctctatatcctgaccgtaaacgacttcttgtggcatgacggtataaaggatcattgaatcatccttccttcctcgccctttcgttcctcaatcagctgattcagcttttttatcgcctgtccgacgccgcccacggcatcaattaatccgtaatcagccgcatctttgccgactacgttcgttccgatgtccctggttaagtttccttttgaaaacatcagctctttgaatttttcttcggaaatatttgaatgatgggtcacaaagttgacgacccgctcctgcattttatccaggtattcaaacgtttgcggaacgccgataaccagacctgtaagccgaacggggtgaatggtcattgtcgctgtctccgcgataaaactatgatcacatgacacggcgatcggcacacctatggagtggcccccgccgagtacgattgagacggtcggttttgataaggatgcgagcatttccgcaatcgcaagccccgcttccacatcgcctccgacggtgtttaagatgatcagaagtccttcgattttcggattttgctcaatggcgacgatttgcggaatgacatgttcatatttggttgttttattttgcggcgggagctggacgtgcccctcaatttggccgatgatcgtcaggcagtgaatattggtatcttgggacatttgcggcagagatgtctctcccagctgctgaattttgctcataatgctgtctttcgcatctgatttttcgggctgctgttcttcggtgttttccatacgatgatccattttatctttcaccctttccgaatgtctctttgtattatgaacaaagatgatgatttccatccgggacatgaacaaaaacaaagccggagcatcatgcgctccggctttgtatacattatacttccataatgatcggaatgatcatcggcttgcgttttgttttttcataaaggaattgattcagcgcatcacgcattgcttgtttcagcgtggaccattctacggcagatgtttccgtcgcttcagtcacgatagagcggacgagctcagtagcttgtacaattaacccctctgattctctgacatacacgaaaccgcgcgtaatgatctcagggcctgaaacaaggttcttcttctgcttatcgagtgaaatcacgacgatgagaatgccgtcttgtgacaataagcggcggtctctcagcacgatgttgccgatgtcgccgactccgaggccgtcaatcagaacgtttccgtatgtgactttatccccgattttcacattctggccgcggaattcaacgacatcacctttttcaatcaagaaaatgtcgctgcgtttcatgccgatctcttctgcgattttggaatgcgctttttgcattctgaattcaccgttaaccggaattaaatatttcggtttcagcaaattaagcatgagtttcaattcttcctgcgaaccgtgaccggacacatgcactcgtttttgggcgaaaatgacttgagcgccggcgcgggcaagcaggttgacggttttggaatatatcaattcatgccccggaatcggtgttgatgcaatgacaacggtgtctccttcttcaatgttaagctgcttgtgcgcctgcttggccattcgcgtaagagcggccagcggctcaccatggcttccggctgtaacaattgccacgtcccgcttcggatattttttcacatcctgcacaggaataaacatttcatcttcggcttcaatatagccgagcttgcgtccaagctgaagcacgttttgcagattttttccggcgattgcaagtttgcggccgttctggacggcagcctgtatcacttgctgaatccggttgatattagacgcgaatacagcaatgatgacacggttttctgaattgttcatcgcatcggaaatttcaccgcttacatatgcttctgacggagtataccccgggcgctccgcattggcgctgtcagaaagcagggcgagcacgccgctgtttccgattttggcaatttcgccaatatcacatgattgatgataagcaggcgtctggtcaaatttgaagtctcccgtgcatacaatagagccaagtgatgttttgaagctgactcccactgaatccggaatactgtgaatcgttttaaagaacgatactttcgttgattcaaatgtaatgactgatttagagtgaacttcacgtaaatcagcttttcgattatgcccgtactgcttgagtttttctctcagtaatgcaagcgtaagcttcgttccgtataccggcaccgacagcttgttcaataaataaaagacgcccccgatgttttcatcgtgcccgtgtgtcagaaagatggccttcacgcggtcagcccgttctactaagtaggaaatatccggaatgacgacatcaataccgagcatttcattttcagggtgcatcagccccgcatccactacaaatatgtctgagtcaatttcaatgacatataggttcttcccaatttctccgacgccgccaagggcgataattctgacgttttctgtatttttctttttcaaaatctgtatcctcctagtctcatacccgtccatcatcacttgttcctattataactgatatcaattttagaaaacaagaagaagcggaaggtttagggaaaaccaatatgtatacaaaacggtcaaactcacgataaaaatgagaatgaccgcgtatttcaactgtataaattttttcttacagttcgctgatgacgctgctcaggctcagacgttcatcttcattcagcgggataagaggaagacgcacagatccgacatcaaggcctttcagctgcagcgccgttttgaccggagccggattaggcgctttaaagagctccttcatgatcggcagaagcttctgatgaatcagtgccgcggttgccgtctgcccgttcgtatagtttttaatcatctgctgcatgtcagaacccacaatatggctggccactgacacgactcctcttccgccgactgcaagaataggaagcgttaacccgtcatcacctgaatagacgtaaaaatcttccggcgtttcggcaatgattttcgtaatggcatcaagatcgccgctcgcttctttaatcgcagagatattcggaatctccgcaagtctgatggccgtttccggcgcaagcgaagcgaccgttctgcccggcacgttgtaaagcatcacaggaagagacgtttcttcagctatggctttaaaatgacggtacatcccctcttgggaaggcttattataatacggcgtgacaagcataacgcaatcgacgccggcttcttcagctttttttgtcagtttaatggaatctttcgtattgttgcttcccgtacccgcaataacaggcacgcgtccgttcacttctttgactgtaaattcaaagagtgcaattttttcttccgttgaaagtgtcggggattcgccggtcgtgcctgcgacgactaaagaatccgtgccgtttttcaacaaatagtcgattaatgtagacagtttttgaaagtctacattccctttactgtcaaagggggtaatcatcgctgtagatatatttccgacattcatttttttcacctcatcatgattcaatcacatttactttgaaagttcaaacacttcatgcagcgcatttacggccgttaccatatctttttcatgaacgagcacccagatcgtcgtatggctgtcggcagattgcagaatcggaatgcctttatcagaaagtgcggagacgatttttgacgtgacacccggaacacccattattccggcgccgaccgctgacactttcgcacagctttccgtcactgtcggctcatatcctaattcagccaaaatgctgcgcgcggcttccgttttactgccggctacggtatatacgatttcactcggcgtaatgttaaagaaatctacactgattccggcatttgccattgctttaaagacttcagtctgaacgttgtattgccccattttggcgggaaccttaaattgcgtcacgtctttcacatgggcgatccccgtaatcagccgttcgaatacatcgctgccgatgttagacgaatgatgggacgtcaccaaagtgcctttgtcttttgaataagtggagcgcacgcggatcggcacctttgcctgcatggcgatttccaccgcgcgcggatgaatgactttcgcgccttgataagcaaggttgcagatttccgtatatgtgacattcggaagcggcttagcattttccacgattctcggatcggctgtcataacaccttccacgtccgtaaaaatgtcgataaactcagcatcaaccgccgcgccgagcgccgccgctgatgtatcgcttccacctctgccgatcgtcgtcgtgtcgcctttttcagtcgctccctgaaagcctgcgacaacgacggcatcatggctggcgagtgcagcgaaaagccgctctgttttcatttctataattttggcgtcagtatgctgggcattggttaaaaagccggcctgagctcctgttaaagctgcggcttttatgccgttttccttcagcatgctggaaaaaacaacggacgaaatcgtttctccgcaagacagaagcatatcctgctctctcggagaaatgtcggactggctgccgtaaaggagcccgattaaagaatctgtcgcgtacgggtctccttttcttcccatcgccgatacaacaacgacaaccttataaccttcacttatggcatcttttatgtgtgctagcgcaagcttgcggcctttgtcatcttttacggatgttccgccgaatttttgaacaatgatcttcactattttcactccaaattagtctgacgtaacagaagagagcaggcagagccttactctcttctgttcgcctatagaaaatacgtttgttttatacgaggttcagtttttgcaggctttccgcgatttgaactgagttccaagcggcgccttttaacaggttatcagaaacaacccacaaatgaaaaccgtttgctctgtccaaatctttccgaattcttcctacaaatacatcgcgtttgccgacgcaatcagcaggcatcgggtaaagctgctccgccggatcatcctgaagcgtaacacccggagcttcttttaaaagctgtttaatatcttcaacggttgcgtcatcacggtcaagctcaatgtaaacagattctgaatgccctgtttcaatcggcagtcttacacatgtcgcagccacttccagcttcggcatatgcatgatttttttcgtttcattaatcattttcatttcctcaaacgtatagccgttgtcttggaatttatcaatttgcggaatggcgttaaatgcgatttgataatgctttttgtcgcctttaaccggcataatggacggttctgcgggttcattgtttaaaatcgcctttgtctggctgtacaattctttcgccgcttcattgccggctccggacacagcttggtaagtagatacaatgacttttttcaaaccgtacgctttgcggatcggttcaagcgcagccaccatctgaatcgttgaacagttagggttggcgataatgccgttatgtttgtgcagatcaccttcgttcacctcaggcaccacgagcggtgtattttcgtccatacggaatgcgctcgtattgtcaatcacgatggctccccgttttacagcctcaggcgccaagctttgtgatacgcttccgccggcgctgaataacgcgatatgaacgccttcgaagctttcaggaacagcttcctgcactgtatattcttcgcctttaaacgttactttcgtaccagcagaacgctttgaggatagtagtgtgagtgtttcgatttcaaagtttctgtcttccagtgttttcagcatttgctgtcctacggctcccgtcgctccgacaactgctacgtgtaatcctcttcccatctgtaaaactccttccgccaattaagcatcatttgttgaattgactttgcattttacgttttattttaccatagaatagtcacggattgaccgaatttttttattccggaatgattttctgtcatcatgattttttattcatgatggtgtacgagcaccggctgaacctgctggtgcaaaagagctttttctaccgtaatcggaaggagatccattctggcgacgagcgatgtcggttttttcacgtggtcatcctggccgaacgggatgaaatatatgttttttgcggacatcagcctcattaaattcgttccgtttaaaccgagtccgtcatttgtcgaaattccgagcacgaccgggcggccgttgcggatcgtggctttcgcagccataaggacggggctgtcggtcatcgcatttgcgagtttgctcattgaatttccggttaaaggggcgatgaccatgcagtcgagcggaagtttcggcccgagtggctccgcttttacgatggaatcaatcgcctcaaagcctgttgtttcttcaatttttctgacccaatctcccccctccccaaagcgggtatcggtcgattgaacggttgatgtcacgaccggccggacttcagctccttgactgataagcgcctctatttgcggaaacacttcctcatatgtgcaatgcgagccggttaatccgaatccgattcttttccctttcagagacatggttatttcccctctttctttaagtctgccaaaagcttgctcaatacgttcgcaataatctgtccggctgttttcggggccacaattcccggaagacccggagcaagcagcgctttaatgccttgtttttcagcatatttgaaatccgttccgcccggacgggatgctaaatccaaaatcaaggtcttgggcgtcatgcgcgataaaacgctttgattcagaatcaagctcggtacggtgttaatgcagatatcaatatcatttacatgatcagtaagctcttcaagttgaaaaggagaaagccccatttccgatatacgggctaaatgagccgaactccgcgcgcccacttttactttcgcccctaacgctgcaaacgtccgggcgatcgtcataccggtgcgccccatgccaagaacggcgacatttgatccgtgaatggtataatccgtatgctgaatcgccatcatgattgttccttcaacagtgggaatcgagttgaatatcgcgatgtcgtcccgctcaaataatttcacaagcttacggccggcttcgctggcgatcccctcaagatacgcgttggagatgcctgaataaatgacgcaatgctccggtgtccgctcaagatagctctgctttaataccacttcttcatttgaaaaaaccgtggaaacaacgccttctccggtcgttgccgatacaggcaggatgatactgtctattttttgaaagggaatctcatcaattttgcatttgacggttcctgtaaaaccgtcatccaattggtcaaaccctgcaagataaatatcggcatgctgttctgtcagctttcttataatctcaagctgtcttgcgtcaccgccaatgatcgcaattgttaatccggttaacatctgaaacgttcaccttctttacagttactggatcctttaagtgtcatcctcctcttcatcgtatgtgcaaagagaaagggcggtgaatgtacagcgtctttttcataaaaaaagcaccggctgtatgagccggtgcttgcaaaaaatgaataagatctactcttcgggaggcgtgatctcccccggaacgtctaaaatgatcatgtctgacccgattttttggatatggttccaggggacgcggatgtcgtggccttgttttcgcagtccgaaccattttaccgtcggtatcaacagcgcggtaatttgtccgtcctgttcattaatttccaaatcggtctggccgagcacgccgagccgctctgcccgtttaatatccacaatttctttacctgacagttcactgagcctcatgatagccacccccttgtactatatgacccggagcaaaaaaaaatgcctgccccgtacagaggcagactgctttgcagcttaagacgaggccggtatattgccggtcgggctgatgagcgatagtgcgtaatcatccgtaaataagcggcggctgaggccgttgacgctttccaggctgaccgcatttaattcagcgataatttcatccatggtcttatgctttccgagcaggagttcatttttcccgttccggctcattttgctgtttgtgctttctaagctgagcattaagctccccttcatttgctctttgctgttttccagctctttcggggtgataccgtcacgttttagaaccgataacgtttcctgaatggtttcagacagaagtccgagctgattcgcgccggtgcctccgtaaatcgtcagcataccgctgtcttcataggaactgtgatagctgtatacagaataggccagtcctttatcttcgcgcacatcctggaaaagacggctgctcatgcttccgccaagcacgttgtttaagacgatcaaatcgtaaatgtccggatctccgactttcaggcctttgaaaccgagacagagatgcgcctgttcggtgtctttttttctcgtcagcttttcataatgaaactcaggctcgctgatgccgcttgctttgcccttcgcttcgtatgtaccgaaccatttctccacgtctttaatgaattgttccgttacatttccggcgacagaaatgacgacgcggtccggcgtgtaaaagtcatccatatgctgtctgagagaatcgccgttaaacgacgaaagcgtttcctccgtcccgagaatcgggtatccgagcgaatgattgccgtatgtcgctttgctcagcagatcgtggacaatgtcatccggtgcgtcttcatacattttgatttcttcatatacgacgttcttttcttttttgagctcatcttcgtcaaaagcagaatgaaagaacatatcagccagcacatcaagtgcgtagtttgcatgctcatccagcactttggcgtaatagcacgtatattcttttgaagtgaaggcattcacttggccgcctatccgatcgaaggattctgcgatttcacgtgcggacctggtatttgttcctttaaaaaacatatgctcaagaaagtgcgaaataccgtttgtctccggcgtttcatgacgtgatcccgtcccgatccatacgccgattgccacagaccgcaccgttggattattttcaagcacaactcttacaccgttttggcatgtatagcgttttatcaagtctgttcctcctattcaaagacaggcagctgcctgctacttcatcagcctgttttcatccattaagtcagacactgagccgagcgcgtagcctttttctttgatttttgcaatcagtgtatccaggcttttcgcagtcggatcagtcggatgcattaaaatcatggctccgttatgtattttgctcagcacccttgtttgtaaaacagcgggagacggtttttgccagtcaatggtgtcaacggtccacatgatggtgcccattcctttttccgccgcaaggtcgaccacggcttttctgaagctgccgcttggcggcgcaaaccatttcggcttcatgccgagcgtctcgctgatttgtgcattggttttgtcgagctgttcggaaatgcttcctgaagtcagtttgctcatatcagggtgattgtatgaatgatttccgatttcatgtccgtctgccgctatttttttccccagttcctgattgtttttcagccatttcccttcaagaaagaaagttgctttgacctggtgctgcttcagaataggcagcatttgctccacgtattcatttccccaggcgacatttatcaggaaagcgaccatcggtttgtcgggatttcctttataaatgggttcgggcgcgagagaatcaagatggactttcggctttacctgctcatagacaaggtcgtcttcgtgaaattctccgtcctttttcatttgtttataggatttttccacattgacttttaaaccgttatatcccggtatactcttccatattttatcaatccgagcgtcttgcggcttcacttcatactctgacgctttttgcagtaattcttcatagagcggatcttttgatgatgacacagttaccgcgtcttttttcattgcgtctatgtaatcaactgtatacgggttttttaacatttcaaacgaaacaaaaaaaagaaataaaaaaacggcaaacggcacgaattttttcaacatgtccttcccccctcatcacacattatgtatgaggaggacaaggtagaacccgtctgttgtctttctcaaaataaagaagccgggtctcccaggctccttgttaggttttcatttaagattgttgttgttcctgttctttttctttctcttcgcgcagcactgctttacgcgacagattcactcgtccctgtttgtcaatttcagttaccttcacaaggatttcgtcaccgattttcacaacatcctcaaccttgccgacccgttcgagcgctagttcagagatgtgaacgagaccgtcttttccgctgaagatttcaacgaaagcgccaaatttctcaatccgtttcactttaccgaggtaaagctggccgacttcgacttctctgacaagatcttcgatgatttttttcgctttttggttgctgctttcatcagtagaagaaataaagatggtgccgtcttgttcaatgtcaattttaacaccggtatcttcaatgattttgttgatttgtttaccgctcggtccgataacgtcacggattttatccggattaatggtcatcgttaaaattttcggcgcatattgagaaagttcttttcttgattcaccaagcgtgctgagcatgctgtccaagatttccattcttccttttttcgcctgctgaagcgcttcttcaagaatttctcttgaaaggccttcaattttaatgtccatttgcagcgctgtcacgcctttttccgtgccggctactttaaagtccatgtcaccgagggcgtcttccatcccttgaatatccgtcaatactgtatagtactcgcctgatttcacaagtcccatcgcgatacctgcaacaggggctttaatcggaacacctgcgtccatcatggcaagcgtacttgcgcagatgctggcctgtgaagtggaaccgtttgattcaagcacttcagatacgaggcggaccgtatacgggaagtctttttcattcggaatgaccggctcaagcgcacgctctccaagagcaccgtgaccgatctcacggcgtcccggtccgcgcatcgggcctgtctcccctacgctgaactgcgggaagttataatgatgcataaagcgttttgactcttccacgcctaaaccgtcaagaatctgaacgtctccaagggcgcctaatgtacaaacgctgagcgcctgcgtctgtcctctcgtaaacagcccggatccgtgcgttctcggcagaagaccgacttctgaagaaagcgggcggatttgatcaacgccgcggccgtccggacggactttttcttctgtgatcaaacggcgcacttcgtttttcacgagtttagacagtgtctgtttcacttttttaattgtatcttcatcatgctcttcttcttcgaatttcgcgacaactgcatttttcacttcattgatcgcgtcttcgcgagcatgtttttcgtgaacctgaatggcgctgagaagatccggctccgcaaggctttttacttttgcgctgagctcttcgtcaatttcatacagttcgatctctgttttctctttgccgactgctgcgacgatttcttcttggaatgcgatcaggcgcttgatttcttcgtgaccgaacataatcgcctcaagcatgatttcttcaggaacttcatccgctccggcttccaccatgttgatggcatcttttgtgcctgcaacgatgaggttgatatcacttttttcaagctggtcaaccgtcggattgatgacgaatttcccgtcaatgcggcctaccgtcacacccgcgatcgggccttcaaacgggatatcggaaacgcaaagagcgagtgatgaaccgaacattgcagccatttcagatgagcagtcctgatcaacactcatgacaatgctgatgacctgtacttcgttacggaatccgtctgcgaaaagcgggcggatcggacggtcgatcagacggctggctaaaacggccttttcacttggacggccttctcttttaataaaaccgcccggaattttacctactgcgtataatctttcttcatagttaacggtaagcgggaaaaaatctagcggtttcggttcttttgatgcggttgctgtgctgagcactgcagtatcgccgtagcggaccatgacagcgccgtttgcctgtttggcaagctggccggcttctactgtaagctgtctgccggcccaatctatggtaaagacatgtttctcttgtcccattcgattacgagctcctctcttaatgtgtgaaataatcaattactcctattatgaacgaaatgaattgaacatatcaatgtcaaagtagtatgtaaaaggatttcattgtttttttattattatttttttcgctttaatacgataaaaaagcgggaatcctcccgctttttacgattatcgacgtaagcctagtttgttaattaactcacggtaacgagttacgtctttattacgcagatacgtaagaagattacgacgtttacctaccattttaagaagaccgcgacgtgagtggtgatctttcttgtgagtacgcaaatgctcgttcaagttgttaattgagtctgttaggatagcgatctgaacttctggagaaccagtatcagattcgtgtgttttgaactcgctgatgagttgatttttacgctcttgagtaattgccatcctgtttcacctccatatcataattagccccagttacctagcaaccgtcggtgacttcggattgccaagcaatggttttaagactacgaaacatatgatactaaaaatcgcgcccatatgcaaatcttttagaataaaatttgtgtacttttgatgttttttccgttatttgctgaaaaaacggatcgcttcttgtttgtctttcccgatctgagccgtcagttcatcgatgccgttaaacttccgttcgcttcggattcgtttgtaccactcgattttaacgtcttctccgtatacatcctgttgaaaattaaacaaatgaacttcaattgacggctgatcgggacgcttttcataaaaggtcggtttgtagccgatgttgcagacgccttcatacacctcgccttttatttcggctttcactgcatacacgcctgtcggcggcacgatatagctgttgtgcaggccgacattcgcggtcggaaaaccgatggtgcggcctctcttgtctccgtgaatcacagtgccccggagaaaatacggctggccgagaagagtgtgcgcaagttcaacgtcaccatcctggagcgctgaccggatataagtggagctgatctttctgtcctgctcggtctgtttctcgacagtcgtgcatccggccttgccgtttaaatcgtccggcagcgtctccatcgtgccttttccgtattttccgtacgtaaaatcgaagcctcccacagcgtgccgcgcgttcaaccctaaaatatactcctcggcaaactgttttggagacagagacgcaaacgcttcatcaaactttacgacatacagcacatcagcgcctaaacgtccgatctggctgattttatcttcaagcggcgtaatcagatcctttggctctttgtccctgcccaacacatgggaagggtggggatgaaacgtcataacggccagcgacaggcctttttcttcggcaatttgtctggctgttccgattactttccggtgtcccaaatgaacgccgtcaaagtagccgagcgccatgacagacgccggctgctcttctttttgtaaatgatgcggatgagaaatatgtatcgtcttcacagaacggtcaccttttttcttattgttcgcttttttgcatgagcactttagccggtttcagcagtcctttttttgaaggatgcggcatataaatggccacacattctccgtcttcagtacagaccgctatacgggcgtcagctgtcattgcagaaaattccgccgggatgtcaaacactgacccgttttcagctttcttagctaatgtatcacttatgacccatttcggcaaatgattgagcgctctatcgatcggcacggcatgctctgcaaccgttccgtccgaaacctgctgttcaagttcctcaaacgtgaaacactcatcaaggctgaaatcgccggaagcagtgcggatgagatgcgacatatgcgcgggatagccgagtttttcaccgattgtcaccgccaacgttctgacgtaagtgccttttgagcacgtgactgtaaagcggaatgatgctgtgtcttcgttataagtgacaggggaagtgagcgcgatatcttcaatcgtgatattccgcttcggccgctccacttcaatacccgctctggcgtattcatagagctttttcccgttgacctttaccgcggaatacatcggcggcacttgctcctgcggtcccttcaattcgtctaaaacggctttgatatccgcttcttccagcggctccctgacaggctttacgctgaccgtttctcccgtctgatcttcggtcgatgtggagaaaccgagagtgatctcagcatcgtacgtttttgacttgtcggtgacgtactcaacgatctttgtagcccgtccgacacagatcggcagtacgcctgacacttccggatcaagggttcccgtatgcccgactttctttgtttttaacagttttcttattttcattacacagtcgtgagaagtcatgccgaccggtttatgtaaaaggagaactccgttaaccatctgtctttcgctcctttgttatcaattgtatcccgtaaaacgcagaaaagaggacagacgacactcgcccatcctctttcccgttattcagacggtttatctgaatgcagttcgtgaatcaatgtttcaatacgattgccgtactcaattgattcatcaaattcaaattcaagctcaggcgttttgcggagtctgattcggctgccgatttcggaacggataaatcctttcgctttctcaagccctttcagcgcctcttctttctttttctctccgccgagaacggagatatacaccttcgctatttgcaaatcacctgaaacacgtacgtctgttacagtgagaaatccgattctcgggtctttcagctttcggctgataatatccccgagctcttttttcatctgctcgccgacacggtttgctctcatactcaattcaatcacctctaagttaaaaccactctgttctagtgatcgtccgttctatctcgggaaaggagtcaataaacgcgagtacgcgctggatctccttttccgcctgaacgtgagaggaagagacgacagcgattccgaagctggtccgctgccaagtgtcctgatagccgatttctgcggccgacacgttgaacttattctgaaccctcgttataatccgcttcagaacggctcgtttctcctttaatgatcccgcatcataaatgatgcattcacattccgcaaatccgatcactttctttcgatttcctgcatgacatacgcttcaaggacgtcgccttcgcgaatgtcattgtatttcttaatcgttataccacattcatatccttgtgaaacttctttcacatcatctttgaagcgtttcagaacgtctacttccccttcgaagatgaccacgccgtcacggatcaggcggagtccgctgtcacgtgtaatgtggccgtctgttacatatccgccggcaatcgtgccgattttcgacactttgaatgtttggcgcacttcaacctgaccgatgactttttcttcgtattcaggatcaagcattcctttcatcgccgcttcaatttcttcgatgactttgtaaatgatacggtgaagacggatatctacattttcagcttcagccgtgctcttagcatttccgtctgggcgcacattaaacccgataacgattgcatttgaagctgatgcgagaatgatgtctgattccgtaatcgcaccgacgcctgtgtgaatgattttcacttttacgccttctacttcaattttttgaagagcggctgttaacgcttcggctgaaccttgaacgtcagcttttacgattaaattgatgtctttaacatcgccttgtttaatttgttcaaacagatcatcgaggctcagcttcgctttgtcgctgcgctgttcttccagttgcttggaagcgcgtgcttcaccgacagaacgggctgttttttcatctttaaagacgaggaattgatcgccagcctgcggtacgtcgtttaagcccgtgatttctacaggtgtggacggtccggctgttttcacgcggcggccgagatcattgaccatggcccgcacgcggccgaatgtatttccgacaacgatcggatctccgacatgcaatgttcccgtttgaacgagaagtgttgcgacagatcctcttcctttatcgagctcagcttcaataaccgttccttttgcctgacggttcggattggctttcagctcttccacttcactgacaagcagaatcatttcgacaagctcgtcaattcccttgcctgtaagagcagacagaggaacgaaaatcgtttctcctccccatgcttcaggaacgagtccgtattcagtcagctcctgcatgacacggtcagggttcgcgctttctttatccactttattcacggcaacgataatcggaacctcagccgctttcgcatggttgatggcttcgactgtttgcggcataacgccgtcatcagccgctacgactaaaatggtaatatcagttacttccgcaccgcgcgcacgcattgttgtgaacgccgcgtgtcccggagtatctaagaacgtgatttttttgccgttttcttcgatctggtacgccccgatatgctgggtgattccgccggcttcaccttcaacaacctttgtttttctgatgctgtcaaggagggtcgttttcccgtggtcaacgtggcccatgatcgtcacgacaggcggacggatttgaagatcttcttctttgtcagcctcttcatatttttcaagctcagtttcttcaagcacaatcacttcttctgtttccacaccgtattcagatgcgatcagttcgattgtgtctttgtcaagctcctggttaatggtagccattacacccagaagcatcagttttttaatgagttcagacggttctttgccaagttcttcggctaaggccccgactgttaaagagccggaaaacgtaattttctcaggaagctcttttttcggcttcagcggtttttgctgatactgatttttgttgttatgattgcgtttgtttttgtttttgttgttgttgttattcttcttgtttttgttaaattgattattctgcacgtcattcttctttccgtctcgaattttgtttggttgattcccagcaggctgctgattaatcccttgcggcttgtttttgttcgtttccgcaggcttctgagatgtaacgccggcgccgccttttttaaatttcgcatcaagctgcttaatggtcttttcttcaagcattgccatatggttatttactactatatccatgtttttcagcgcagtcaaaatttccttgcttgaaacattgatggcttttgcatattcgtaaactctcattttagccattcgttcacccccaaaaatattaatcgagcaagctgatcagcttattcgcaaaaccttggtcagtgacggcgacaacgacacgtgattccttgccgatagagcggccgagatccgcgcggctttcgacttttttataaggcactttataataattgcatttatcggatactttttttgcagtattcgcagatgcatcttctgtcagcagaacaagttttgcacgcgcatttctaatttcttttataaccaagtcctcgcccgacacgaccttacgagctcgattggccagacccagcaagggaaaccattccattccagacatgttattttttcaccttttccgccagttccagcaattcttcgaaaatctggtcatcgatttgtgattgaaattgattttgcaatgtgtttttctttttcgcagctaagatgcattctttctcaagggtgatataggcaccccgcccgttcttctttccggtcggatcgactgaaatctctccttctttagaacggacaattcggatcagttcctttttaggcttcatttcccccgttaccacgcatttgcgcagaggaattttttttcgcttattcacctaaagtcacctcttattcatccgattcggctgtttcaggctccataaagagcggctctaaatcgtcatcttcttcatgctctctcggatagatgccaaggtctcttgcatccgtttcacttttgatatcgattttccagcctgtcagtttcgcggctaagcgggcgttttgccctctttttccgattgccagagaaagctggtaatcaggaacgatgacagtcgtggctttttcttcttcgctgacgatgacatccagtactttagacgggctgagcgcattggcaacaaattcaaccggatcatcagaccagttgacgatatcaattttttcgcctttcagttcattgacgatcgcctgcacccgctggcctttaggaccgacgcatgaaccgaccggatcaacgtcagggtcatcagtgcggacggagattttagagcggtcgcccgcttctctggcaacggatttcagttcgaccgttccgtcataaatttccggcacttcgatttcaaaaagacgcttcaacagaccaggatgcgttcttgatacatagatctgcggcccttttgtcgttttttcgacttttgtgataaatactttaatccgatcgtgcggtttatagctctcattcggcatttgttcattgacgggcagcagcgcttcaatcttgccgagagacacgtaaataaacttgctgtctaagcgctgtacaattcccgtcatgatgtcttcttcacgatcgataaattctgagtaaatcacgccgcgctcagcttcacggacacgctgcgtcaccacttgtttcgccgtctgcgcagcaatgcggccgaagtctttcggcgttacttctatttcaacgacatctccgacaaggtagttcggatggatgtgctgggcgtcgtcaagcgagatttcaagtcttgaatcgtatacctcgtctacgacatcctttcttgcgaacacgcgaatcgtgcccgtctcacggttcagatcgacccgtacgttttgcgcctggttaaaatttcgcttatacgcggaaattaaggcagcttcaattgcttcgatgataatgtctttactgatgcctttttctttttcaagaatagtgagagcatctaatagttcactgctcatgttagcggtctccccccttaaacactaatacttcattcattaaaatgttacagctaatcttgcgttagctattttttcatacggaatattgacccgtttctttcttgttttgaccgtcatctctattgtaacagtttgtccatcaaattcagccaatttgccttcaaacacttttaaaccgtcaatcggttcgtacgttttcatgtacacatttttgcccagtgatttttcgaagtcggcttttttctttaatggacgctcggctccaggagaagatacttcaagaaagtagttctgagtgatcggatcggcctcatccagcttttcgcttaacgcttcgctgactttggcgcactcctcaatatcaacaccgttatcggaatcaataaacacgcgaaggaaccagttttgaccctctttgacaaattcaatgtctacgagttcaagctgaaggtcatccagtatgggctgagccattccttgaacggtatcagtcacttttttgctcatgtttttcctccttgtgctgtcgatatcatatcagccgttcctctgcataaaaaccctgcttcaaaagagcaggggcattgagaaaacgatggacatgtcgaggcaaaattgcctgttcaatacaaaagagcgggtttccccactctttgcctcggtaatcgttagcatttccaataaaactataccataaccatatatttaatgcaaatcaaactccgctcggaggctgtgcacaaagcttaaaacagagacagctgattttggtccggaagcgactcaagacagccgtgacggtctaaatactctaaaatggtttttgacacttttcctcgtttttgaagatcctcttttgaaaggaactccccttcttcccgtgctttcacaatattgagagcggcgttggttccgagtcccggaattgagttgaacggcgggatgagactgttgccgtcaatgataaattccgaagcgctcgaacggtatagatcgaccttctggaaggaatagccgcgctcacacatttcaagcgcaagctctaacacggtaaggaggtttttctccttcggcgaagcatcaagccctttagagctgatatcatccatcaccgctctgatggcggtcgagcctttaatcattgtatcaatgtcaaagtcatctgcgcggacggtaaaatacgcagcataatataaaagcgcgtgatgcactttaaaataggcaatccgcaccgccatcagcacgtatgcggcggcgtgggctttcgggaacatgtatttgatttttttgcatgaatcaatataccagttcggcacattgttctttttcatttcttcttcccattccggcgtcaggcctttgcctttacgcacgaattccatgattttaaaggccagtgaaggctcaaggccctgataaatcaagtaaaccataatgtcatcacggcagccgatcacttcgctcagttcacacgtattgttgtgtatcagttcctgcgcgttgccgagccatacgtccgtgccgtgggaaagcccggaaatctggacaagctcggagaacgtcgtcggcttcgtatcctcaagcatctgccgcacaaatcgcgtcccgaattcaggaataccgagcgtccccgttttacagccgatctgctcttcagtgacgccgagcgattctgtaccttggaaaatcttcataacttccggatcatctgtcggaatcgtcttcggatcaattccgcttaaatcctggagcatccggatgactgtcgggtcatcgtgccccaatatatcaagcttcagcaggttgtcatgaatggagtggaagtcaaaatgagtcgttttccattcagaccccgtcgcatctgccgggaattgtatcggggaaaaatcgtaaatatccatgtaatccgggacaacgataatcccccccgggtgctggccggtcgttctcttaacgccggtgcagccctgcaccagacggtcgatctccgcgccgcgcatgtgtaggttgtgatcacccgcatagcctttcacatatccgtaagccgtcttttccgcaacggtgccgatcgttcccgcgcgatacacgttatcttcaccgaacagcactttcgtgtagttatgggcatggggctgatactcacctgagaagttcaagtcgatatcgggtactttgtcacctttaaagcctaagaacgtttcaaacgggatatcatgcccgtcctttttcaaaggtgtgccgcaagacgggcagcttttatccggaaggtcaaaaccggaaccgactgatccgtcattaaagaattccgaatatcggcagctcgggcacacatagtgcggagcgagcggattcacttcagtaatttccgttaaggtcgccacaagcgatgaaccgacggacccccgggagccgacgagataaccgtcatccagagaccgttttacaagcttatgggagatgagataaataacggcgaatccatgaccgatgatgctttttaattctttttctattctcgcttccacaatttcaggaagctcttcaccgtaaatgcttctggcgcgctgatagctcatttcacggatttcttcatcggctccgtcaattttcggcgtgtacagatcgtctttgatcggtttgatctcattgatcatcgaagcgactttctgcgtattgtcaaccacaatttctttcgctttttccgcaccgagaaaggagaaagcatccagcatttcatctgtcgttctgaagtgcactttaggcagttcgtgcctgtttaacgggttggcgccgccttgggaagatattaagatcttccggtaaattttgtcctcatcgtttaaatagtgaacatttccggtggcaacgaccggcttattcaatttttccccgagcttcgtgatgttggcgatgatttctttcagcgctttttcatcccggacgagctcaagctgcagaaggtgtctgtatacttccggcggctgcacttcaagataatcatagaatgatgcgatatcttcaacctcttcaggtgatttttgcatcatgccttcaaagacctctcccctgtcacaggcagagccgattaacagaccttctctgtatttattaagctgcgacctcggaatgcgcggcactctgtagaaatattgaatatgagaaatagacacgagcttaaacagatttttaaggccggtctcatttacggcaagcaatgtagcgtgataaggccttgatctttgataagcattggattgtcccatattctcattcagctgatcatgataaaaaatgtctttttcagcggcatctttgagcattttcaacagcaggtagcccgttgcttcagcgtcaaagaccgctcggtgatgctgggttaattcgatatcaaacttcttacataacgtatttaagcggtgatttttaaactcaggatacaggaaacgcgcgagttccagcgtatcaatgactggatttttcgctttttccgttttcagtagacgcttgtacgccacatttaaaaatcccatatcaaagctggcgttatgagccacaagcacgtcatcgccgatccattctttaaaatcccggacgacgtcaacgacatcgggagcgtcgcggaccatgtcatccgtaatcccggtaagctctatcgtcgttgctgacagcggatggtgcggattggcgaacgcttcgaatttatcgatgatttctccgcctcttattttgactgcggcaagctcaatgatggtgtcatacactgcggacagacctgtcgtttcaacgtcaaagacgacgtatgtgtcttcttccaaaagacggtgagctggattgtatgcgatcggaacaccgtcatccacgatattggcttccattccgtaaatcattttaatgccgtgttttttcgcggcggaataggcatccgggaaagactgcacaacggcatgatcagttaacgcaatcgcttcatgtccccattttttcgcctgttcgacaagctttccgatgcccgttacagcatccatttggctcatcggagaatgcagatgaagctcaacccgtttttcgccttcaggagcggtgtcttcacgggttttggcttttatttcattcacgtcatttgcaatcatgacgaggtctctgacgaatgtatcgttttgaatgcttccccgcgccttcacccacatgccttttttcagcgttttcatcaaagcggcgtcttctttttctctggcgaacatttttactaaaatactgtttgtatagtccgtgattttgaaaatgcagagcgtgcgtccgcttttcagctcgcgtgtttcagcatcaaacacaaacccctgcaccgtgattcttctttcttcatccatgatgctgtcaagcgtccggatttcttcgttctctttaatttgatagccgatgacaagcgggccggacggcgcttgatcctcatcgccctctttttccttcttctccatttcgataagcgcctgcatcgcccgctcctgatcttcagcaagcttttgctcgcggaatttctggacttcttggtcagatacgaaaatttcggtatccagctgcagttccggaaatccgaattggcgatagctgtgctgaatcagtgcgctgtatttatttttgagcgccgatgcttctgtatctgtttttgttttcacgatcagtttgtttcccttgagcttcggcttctgctgattcaaaagagccaccatcggcggcgaggttccttcaagctcttcaatacagcgtgtccaataatcctgtacaagctcctctgtcactgtaggatcgatgacctgaacagacgatgtgacacgggcgatgtgagcaaacgattgtgttaacctcatcatgaatgaatcgtatatttgatacggcaaaagagccttaaagcgaaattggaaatgccaggctttttctgctttatggattgtcagtttatcaatctctccgtcttcaaagtatgtcatgaaggtatcatctgtcatattaagctgctgcagaagaatctgaaactgtcttctgtttactgataactgttccattcagacagtatccctcccttaaaacatcataagtgaaggtacctccgcaggtgatgaggtaccttcttttttctctattttaacatgattttgtacgattcgttatggtgattacttcgtcttaataaattcagaaagctcatccactgaaacttcagcagattcaccggttttgcggattttcacttctacgatgccttcgtcggcacgttttccgacagtgatgcggatcggaaggccgatcagatcagaatcagcaaacttcacgcctgcgcgttcagcgcggtcatcgtataaaacctcataaccttccgtctggaattttccgtaaagctgttcagcaagctctttttgcgcttcatttttcatattcagcgccaaaatatgaagatcatacggagcaacgctcttcggccagatcaagcctttttcgtcgtgatgctgttcagcgatggcagaaagcgttctggacacgccgattccgtaacatcccatcagcatcggctgcgcacgcccgttttcatcaaggtatgtcgcattcatcgcttcagagtaacgcgtgccgagtttaaagacttgtccgacctcaatcccttcagcgaaacggatcgtgccttttccgtcaggtgacggatcgccttcctgaatgattcgaagatcggcatacgcttttacagacgcgtcacgttcgatgtttacgtttcggtaatgacggtctttttcattcgcgccgcaaacggcgtttaccattactttcacggcttggtcggcataaatctcaatgtcgccggcagcgccgatcggccccgcaaatcccggctccgtgccaagtttctccgctacttcttcatgagacgcaagctcaaccacttccgcgttcagaaggtttttcactttcacgtcgttgacctcatgatcgcctcttactaacacgagaacaaatcggtcatccgctttaaacagcattgatttgatgcaggcgctcggctcgatctgcaagaacgaagcgagctcttcaatgcttttgacatttggcgtatcaattttctccaatgcctcgggtgtttcatctgacggctcgctgttcatgacaactttcgccatttccgtattggctgcgtaagaggatccatcggaataagcgatggtatcttcccctatttcagaaagagccataaattcatgcgtgtcttttccgcccatcgcgcctgagtcggcaataacgggacggacgtttaattcacagcgtgcgaaaatgctgctgtatgcgccgtacatgttttggtacgtttcctccagactttcttcagaagcatggaaagaatacgcatctttcatgatgaattcgcgtccgcgcaataacccgaaacgcgggcgtttttcatctctgaatttagactggatctggtaaagagtgagcggcagacgcttataagatttcacctcatcacgcacgagagaagtaatgacttcttcatgtgtcgcgcctaaagcaaattcacggccgtggcggtctttcagacgcattaattcaggcccgtacgtataccatctgcctgattcctgccatgtttcagcctgctgaagggccggcatcagcatttccaccgcgttgattttttccatttcttcacgcacgatcttctgaatgttttgaatgaccctgtaagccaggggcatgtagctgtaaaccccgctcgtattttgtctgataaatcccgctctcagcagaagcttatggctttttgcttcagcatcagccggcacttctctcagggtcggaataagcgtcaaactttgtctcatgtcttcgcacctctgattttttactagtcaattataagaataaacgctggatatcgttccatgtgacaaccagcataagaagcattaagaaagctacgccgataaatacgacaaatgcttccttgtcacggtttatcggcttgccgcggattgcttcaatgaataaaaacagcagccgtccgccgtcaagcgccggtatcggcagcaggttgacgattcccaggttgatgcttaaaaacgccgcaaactggaataggttgataataccggtttttgcaacttgatccgtcatatcataaatgccgacaggacccgaaagcatatcaagcttaaactggcctgtcacaagtttgctcagattggtcaggatcgcttttgtgacatcaacggtagatgtcgcgccgtaagcaatcgctgcaagcgctcctttttcagtcggcgcataagagccgaagcggccgattgtttttttattttcatcttttacagcttcaggtgtaaccgagatatgaaacgatttgccgtcccgtttgacggcgacatcgatttttttcccgggattttcttttaccgctgtcacgatgtcggtccatgacctcattttttcaccgttaatgctctggatatagtcgccttcttttaaaccggcagcagctgcgcgtccattgtctgtcagcttcccgagctcaggctgatttgaaggcacgccttgaatgaatccgagcatgacgagaatgacatacgctaagatgaagttcattatcggaccggcagcaatcgccttaatccgcttccatacgggtttagacccgaattgtcgattgtaaggcgcaatctgcacttcttctccgtctacgataaaaaaagaggtctgactgacagtaaagcccgccagttcatcttctttcccctgctcgtacccggtaatcttcatttcgtgctcaagatcagccgtctccacctcgataattaaagcgtcgggatatttttccttttgattaatgatgactttttccacttcgtcatctttattaaaaagaagcccgacggtataaccgggtttgacttcgatcatctccgggtcttcaccggccatgcggacgaaccctccgaccggaaggagtctgatcgtatacacggtttcattctttttaaatgaaaagattttagggccgaagccgatcgcaaattcacggcaaaggattcccgctctttgggcgagcaataaatgcccgagctcatggaaaaaaacgagcgttccgaaaataataataaacgcgataactgtattcacgaacataccaccttatgtgagtattgaattaacgtatccccgggtgtctttgtccacttcttggatatccgcaagactcggatcctgaattacgctgtggcggtccaatgctttttcaatcaggtcctcaatcgataagaatgaaatccgtccggcaagaaaagcggcaacggcttcttcgttggccgcatttaaaaccgtcggcatcgttccccctattttacctgattcaaaggcaaattgtaagcagcggaacctttcaaagtcagctttcgcaaaatgaaggcttccgatctcccataattcaagcctttttgtttcaggcagaggcagccggtccggatatgtcagcgcgtattgaatcggcaccctcatgtccggatttccgagctgggcgatgacgcttctgtcgtgaaattcaaccatcgaatgaatgatgctctctttatgtaatacaacgtcaatctgttcatacggaatgtcaaacagccaatgcgcttcaatgacttcaagccctttattcatcattgtagccgagtcaatcgtaatctttgcacccatcgaccagttcgggtgattaagggcgtcggcaatcgttacagactcaagctcctgccgcgttttatccctgaaactgccgccggatgccgtaatgatcaggcgctcgatatttttgctctgttcgccttgcagcgcctgaaaaatagcggaatgttcgctgtcaaccggaagaagaggaacaccgtatcgttttgcgtgtcctttcactatatgcccggcagtgacgagagtttccttatttgcaagcgcaattgtttttttctgttcaatcgctttcaaagtcgggattaaaccgacgcttccaagcagcgcattgaccacgatatccacttcgtccatgactgccgcttcaatcaggccttcttctccgatgccgatttgacattcatgcgaaaaagacgcttctttcactttttgatatgtatccatgtcgccgactgctacatatttcggctgaaacgttctgatcaacgggatcgctttctcggcgtttttaccgaaagtcatcgagacgagacggaactgatcttgatgcatgcgcaatacgtctaacgtctgctccccgattgatcctgttgctcctaaaagacaaatattcttcaaaatgccactcccattctatgcgtccagatcggtcttattttcatattagcctttctcatgaaaaaagcgcaagcagaaagtataagaacggcatgacaaacaaaaagctgtcaaatcggtctaaaatgccgccgtgcccgggaaggattttccccgaatccttcacatcatagtgccgcttaagcgctgattcaaccaaatccccgatctgtccgaacacagacagaacaagcgtgatgaccaaaagaaccggatatgaaatcggaaggtgagcaaacagctgaaaaacggccgtaaaaataagggcgatgacaataccgccgagaaacccttccactgttttgttgggactgatttcgggccacagcttccgcttcccgagcgactttccgacgaaatatgcgcctgagtccgttgaccatatgacaacgcaggcataaaagatatacaaaagcccgtttgtttcaatgtttctgatttcaataaaataatgaaaacacagtccgatatataccgtcgcgagaacgataaacccgacttcgtcaaacgtaaaggtgtttttcacgagcaccgtatagctgagcagaatcaatacggcgaaaatcgttacttccattttcgcatcgaaaaaatgatatttgtccggcatcatatacagccataacaacaagaagctgatcagacccggaaaagaaaaaaatctgagctttttcatccgcaaaagctcaaaaagcgctatacttcccatcacgtaaacaaatacggtgaacggcaatcctccgaaaataaccaaaaataaaaatagtgccgctgccagaacacctgttaacagtctttgtttcatttccaccatcctctaaattccgccaaacctccggccccgctgctgaaattctcccactgcctgcagaaagtgatcttctttaaaatcgggccacaggacatctgtaaaaacaaattcactgtaagccacctgccaaagcataaagttgctcagtctgatttctccgctcgttctgatgagcagttccgggtcctggattgattctgtcattaaatgcccggaaaagagcgcttcatcaatgtcttcgatattcagcgtgccgcttttcacctgttcggccaatgcttttgccgcattgacgatttccgtgcgtccgccgtagttcaaagcgaaattgagaatcagcccgtcattttgttctgtatcttttacggccttctcaatcgccctgtacgtatgagaagggagcgcggattcatctccgataattttcacctgtacattttcctctatcaattcaggaagatacgtattcaggaactcttccggaagcttcatcaaaaagtcgacttccatcttcggtcgcttccaattctccgttgaaaacgcataaagagtcagaactttaacgccgagctgatttgcgagctttgtcaccctttttaccactttcattccttcatgatgtccggcaatccgcgggagtgagcgcttcttcgcccagcgtccgtttccgtccataataatggcaatgtgtgcgggaatttcacccttcagtatgtcttcttttgtataccgttctaagttggaagccgcattctgctgattcttccaatttttgagtatgttgagcatgagattcctccgtcacccaaaaaggttgcgttgctgatgatcaatgtaatcaacagtattaacaaaaaaaccccctgtaaacatgagagggtcttttcacattatctattgtacatagtttttcattaaacttccatgatttctttttctttgtctttcgtgacgctgtcaatttttgacacatattcatctgtcagcttttgaacgtcttcactggaagcacgaagctcgtcttctgtaatgtccccgtttttctcaagttttttgaggtcgtcgttgctgtcacggcggacattacggactgctactttcgcttcttccgcgtattttttcacgactttgacaagttctttacgtctttcttccgtcagagccgggatcgcgatgcgaataattgtgccgtcacttgtcggagttacgccaaggtcagctttcaggatcgctttttcaatatcgccgattgccgttttgtcatacggtgtgacaacaagcatacgcgcttcaggcacattgatggaagacagctggtttaaaggtgtttgggcaccgtagtattctactgtcactttatccaatagagatgggttggcacgtcccgcgcggactgacgccaattcacgtgaataagcggcaaccgctttttccatgcgttcttttgtttgtgttaatacttcgtttgacaacgttatttcccccttacgatcgttccgattgattcgccgattacggcacgcttaatatttccttcttccataatagaaaagacgatcagcggaatatcattatccatacatagtgaagaagccgtagaatccatgacttccagcccgtcttttaacacatcgagataagataatttttcgtatttaacagctgactcatcttttctcggatcggcattatacacaccgtcgacattatttttcgccattaaaatcacatccgcttcgatttcagcggcacgcagcgctgcggttgtgtccgtagagaaataagggtttcccgttcccgcggcaaaaatcacaacgcgttttttctccaggtggcggatggcttttcttctgatataaggctcagcgacctgacgcatttcaattgatgtctgcactctggactgaattccgagcgtttccaggctgtcctgcagggcaagtgagttcatgacagtagcaagcatgcccatataatcggccgtcgcacggtccattcctaagtcactgcctgtttttccgcgccataagttgccgccgcctacaactacggccacttcgacgtcaagctcagcgatttcttttacctgtttagcgatggattggataacagtcggattaatgccgtttccctgctctcctgccaatgcttctccgctaagctttaaaacgatacgattgtattttggtttttccataataacctccaagtgtaaacattgccgtttcctattatgcaagagaaaaaaaggtttgtaaatatagttttaaaaatagggaacacaagtagtgtcccctatactgcctgaaaagccgcgaaagattcgccaaggctttccgccattattttttcacttggttcataacttcttcagcaaagttttcttggcgtttttcaatgccttctccaacttcgtagcggacgtaagttttaacagatgcgtttttcgcagccacaacttgtttcactttttcgtctgggtttttaacgaaagcttggtctaataagcaaatttcttcgaagaatttgttcagacggccttcaaccattttagctacgatgttttccggtttgccttcttgaagagcttgctgagtcaggatctgacgctcatggtttgcttcttcttcagacacttggtcgcgggaaatataacgaggatttaccgctgcaacatgcatcgcgatgtcttttgcaagatcttcgtcagttgttccgctaagaacggataatacgccgatgcggcctcccatgtgaaggtaagcaccgaacgcttcgctgtcttcttttgtaagaacagcaaaacggcgaagagtgattttctctccgattttagcaacattgcttgtgatgtattcttcaacagtagaaccgttttccatcttttgacccaacgcttcttcaagatcagcaggagcgtttgcaagaaggtggtcagcaagcgtgttcagaagctctttgaagccttcgtttttcgcaacgaaatcagtttcagagtttacttctaagataacgcctttgttgccgtcagttttaataagagtagaaccttcagcagcgatacggtcagcttttttagccgctttcgcaattcctttttctctcagaaggtcgattgctttgtccatatctccgtcagtttcagtcaatgcttttttacagtccatcataccagcgcctgttttttgacgcagttcttttacctgctgtgcagtaatagccatttgaattcctccttatatgtgtaaacaagatatgtatagatacatttttcttgaaaaaaggtgataaaaggcagtccctcttatcaccttttgattaggttacgcagttgtcgtttctgtttcaggtgcagtctcttcagcagcttccgcttcttcttcgccttgcttcgcttcaagaatggcatctgccattttagaagtaagaagtttgacagcgcggattgcgtcatcgtttgcagggattacgacatcaatttcatcaggatcacagtttgtatctacgattccgatgataggaatgttcaatttgcgagcttccgcaacagcgatgcgctctttgcgaggatcgatgatgaataatgcatcaggaagatccttcatgtctttaattccgccgaggaatttttcaagacgctctaattcttttttcaattgaacaacttcttttttcggaagtacttcaaatgtaccgttttcttgcattttctcgatgtctttcagacgcttaatgcgtttttggattgtttcgaagtttgtcagtgtaccgcccaaccagcgttggttgacatagtacatgccagagcgtacagcttcttctttaacagaatcctgagcttgtttttttgtgccgacgaaaaggatttttccgccttcagcagcaaggtttttcgtgaagttgtaagcttcctctacttttttcactgttttttgaaggtcaatgatgtagattccgttacgctccgtgaaaatgtaacgcttcatttttgggttccagcggcgtgtttggtggccgaagtgaacaccagcttcaagcaattgtttcatagaaataactgacatgtgatttcctcctaataaaatggtttttttcctccgcttaggtcatttttgtgcagaactgccgtttgcagcaccctctgcataaatcgttaagcgtgtgtatttaacaccaagacataatataacacagctttatgcgacaatcaagaatcctttacagctttgccgcgaaattttaaaaacagctcgatttctgtctttccgctctgcacccgtttggcgatttccgcaggggtgagcccttgttcatataattctgaaacacgttcttcaaacgaatgcgcaccgttgttttcgtcactttcagcccgttccgttgcactgatgagcttttccatgtgatccggaatatcaggctcttttttcggttccggccggggttcggcgtcttctgcgtcaggcgcttgatcattccggctttttgtgtcttcgagtctttcattttcttctttcagctcaagcagaaacgctgcaagggtgttttccgtctcttcaagaatcttcttctgctggcgctccgtctccttgagggctgaaaacctcgtgtacagaataatgacggcataaagcagtacgccgtgaagcacaaagcttaaaagccataatagtgttgacatgtttttcactcgctaaccatgagttcattattgaattactttttcaagcaggtgctttaatttaaacagcgcctttgaatgaatctgtgaaatccgcgacgtcgaaaggttcaggacttgtccgatttcggtcaaagtcagttcttctttatagaataaactgacgacaagctgctctttttcagagagctcgtgaattttgcccgcaagctgagcgatcagctcgtccttcatgattttttcttccggcggcacatttttgtcatctctgatcatcacttgaatattctcaccgtcatcctggtcgtgaagcttttcatcaattgataagagattggcaaaaaacccttcattcatcgttgatactacgtcctgctccgtcatcccaagctcttctgcgatctctgaaggcgtcacattccgaaggtagcgctgttcaagtttttcgattgccgcttcgactttttttgtcttctcccgtgaagttctgggcagccaatcttctttacgcagcccgtcgatgattgcaccgcgaattctaaacgaggcataggtatcaaattttaaatcccggccggggtcaaatttttctagggcatcatataaaccaagcataccaaggctcattagatcgtctttatgcaccgatttcggcagtccgacggaaattctgccgacatgatatgtgaccaaaggcatgtaacggcgcattaaatcatcaccggctttaggatctttccactctttccagcgcgaccaaagcacctgatcttcataattcaaggattgcattgttatccccctacctcatacctttattaaatcgttgtttcaccttgtttaacagttcgaatgtgcagcatgcaggactttggctcaaattcaatcgtccggccgcttgagccgcccgtatcttcactgatgaccggaatgttatacaatgaaagctgctctttgatagccgctacattcctcggaccgattttcatcaggtcgtttgtcattttaaacttaaacatctccgctcccccggcgagttttgccttcagggcaaacttgcggcagccggctttcaaaagcatatcaattgtcatcttaacggcggtgtccgcgtattttgcacggttgagctccgccgtttttgataaaccggagtccggcagcatgacgtgaacgagtcctgccgtttgtttgtctttatcgtataaaaccagccccacgcatgaaccgagtcccgaagtccggattttatccggataacgcgcgacttgaacatccgcaatccccactttaacgactgcggcttccgcacggctcataaagccgcacccaatgagacgaagagcttttcaaaagaatcatagtccgggagcataaacatatgggctttgagctcctgccggctgccctggtcaaaaatagaagtatccacgacaatggcatgctctccgacttggctgagctccatcagtccttcactgataaccgcgccgaacatatcaagtgagatttccggcacgctcgggtaaatctcaagctttgtcaaatcagccaatgccgttaaataggaacctgctaaaatattgccgaactcatgtaaagcagaagaactcaaatgatcttcgcccaactggtcaatatcaaaatccggatttccgatcagctctctgataaactgttccgcctgatggaaaggcatgatgagaaagatagagcctgtcatgtcgccttccattcttaaaaagatactggcgaccggcgtttcagccccgccgaaaaaatcagcgagctcatcaaatgtcaataaagtcgcaaacggcacttccatgtctatctttctgttcagcagctgagccatggcagaagccgagtgacccgccccgatatttccgacttcccgcaaaatatccatctgctcttctttgatcgcttcaaacttactcatgttgtcttttcccctttaagcattcggctctccggacgcagatgccgaagcacctttatccagcaccgcatgcgcatcaataatattgaggagcctgttatcttgcttgacgatctgtttaatccacacatccgtttcctttgtctggctttcaggcgcggattcgatttcattttcatgcacggtgatgacgtcattggcctcatccacgacccatccgacatcggcgtcacggtaagaaatgatgataatccgtgtctcttctgtgatgtcctgttcaggctggttcagacgttttcttaaatcaagaaccggggtaattactccgcgcagattgataacgccgcggatatacgattccacacccgggaccctcgtcggtttttgccacttttcaattgatttcacctgggaaactgagatagcgtattctttcccgtttatcataaacacaatcattttttcacctgttttgatttcagcagtcatgcgggcacctcctcgtgtcgttttagtagatcagcgcattgcaatcaataatcagcgccacttctccgtttccgagaatcgtagcgccggaaatcgcaaagacgttcgtcaaatagtcgccgagtgatttcagtacgacttcctgctgtccgataaaagagtccacgacaaaagcagtggatttatcgccctttttcacgacgattacatggaactgatcggcatcctgttttgaatctgtaatgccgaattcttttttgagatagacgatcggaacgatttgtcctctgaaatcaatcacttctctgtcatgcgtctgcaggatatctttcttatcaataacagccgtctctataatagaagaaatcggtatcgcaaacgtctcttcttccagtttaatgagaagaacggatataattgaaagtgtcagcggaagctggatactgaaaagagaaccttggccttccgcggatttgacactgacagagccgccgagtgattcgagtttattttttacgacatccagaccgacgccccgacctgaaatgtcagaaatttgatcggcagtcgagaagccaggagcaaaaataagctcgtaaatctcattatcttcaagcgtttcagcatcacgttcggtaattacactccgctcgagcgctttttcaagaattttctttctgttcaggccggccccgtcatcttcaacttcaataaagacatgattgccgctgtgatatgccttaagcacgacatgacccgattccggttttcctttattcacccgcacttcaggcgattcaatgccgtgatcgatgctgtttctgattaaatggacaagcggatcgccgatttcatcaatcaccgtgcggtccagctccgtttcagctccgatgatggacaattcgattttcttgtttaattccttttgaagctggcggatcattctcgggaaacggttaaagacggtttctaccggcaccatccgcatattaagaataatagactgaaggtcgcccgaaattctggtcaggcgttcaacggtttcagtcagctcattgtggtcaagctctttggcgatctgctcaagacgtccgcggtcaatgacaagttcttcaaaaaggttcattgaagaatccagtctttcaatgttgacgcgaatcgttttcgagccgctgtgatgcttcggctgctcttccgttttcgcttgcggtttcggctgtttttcagcctttttaaccggagtttccttcaccggttcagctgcttgcggtttttcggccgtttttaacggcgcaccggcagaaatttcgacattctccacttctgaaatgccgctgatgagttctttaatttcttcagcaggctgctttgtcaagaaacacacctgaaaatccgttccgaaatcttccgtctcaagcacttccgcggcgggtatcgtttttgcaacttccccggcttcattcagcttttcaaatatcatgtacacgcgcacggctttgagcatgcagctttcattcagggaaaccgttatttcatagcggctgaatccttgctcttccgcctcttcaataacagtccgttcgaactcatcataattccattcagttgaagtctgttgttttgaagccggcggttctgctgtttcggctgaagccgcagtctcatgcgccgcatttacgtcgagcttcgcacttacttcagaaatatcacgtttgccgtctcctccgtcaataatggactgcaccatctcttcaagatgatcaagcgcttcaaacagcacgtccagccaatccgatgtaacgggcatttctccgttgcggatggcgtccagcacattttccatcaggtgggttaaatgcgccagatctgtatatcccatcgttgcgctcatgcctttcagcgtatgggcagctctgaagatgtcatgcacaagctgaaggtctgccggatctttttccaacagcagcagcttttcgttacatgtctgtaagtgctctttactttcatcaataaagacatctaaatattgattcatatccaattgattcacaccctctcttttttcacacatccggtgatggatgccgcgatatcttccacatgtttaatctcatgaatgaggcccgcctttatcgctgacttcggcattccaaacacaacacaggattcgtccgattccgcaatcgttttaacgccgcctgttctgagcatttcttttacgccctcggttccgtcgctgcccatgcctgtcataatgacggctaccttttcgtaaccggataaacggcttgccgaccgaaacaaataatcggctgacggtttatgccggctttccgtatcatgaacatcaagaatgatgcggagccttccgccttcctctgcaaccgtcatattttttccgccgggcgcgatgtacacccatccgtctttcgcttcttcaccgttttccgcttctttgacctgaatatctgacaaatggttgagtctgtctgcaagtgaagcggtgaagccttcaggcatgtgctgaacgacaaatacaggcgcctttaaatccttcggcagtttcggaaccaccttttgcagagcccgcggtccgcctgtagaggtcgcgatgaatacggcctgcttggcggattttgctttcggtctttcaaatcccgccaaagccggacgttccgggatagaagactctttcactgccgcctcaggtttttgtgcgcgggacatcccggctgcaatcaccctctcaatcagctgctctttaattttataaagatcaagtgaaatcgctccggaaggcttagtgataaaatcaaaagcgcccatttccaggcagttgatcgttcggtccttcccttgctgtgtctggctcgataccatgatgacgggaagtttatatatgctgatgatcttccgcaatgtatccgttccgttcatgaccggcatttcaatatcaagcgtgacaacatccggtttgagaagctctattttcttcagcgcctcttccccgtttctggctgtcccgatgacttctatctgcacttccgcagccagaaaatcggtaatcatctttctcataaaagctgagtcatcaacgacaagcacacgaatcactgtaaagtcctcctcaataaaaaagaagataatctctcaataaatgccggtttctcttctcttggtttgttttcttccgtttgaaacaagacatccgtcagaagacggacggacctgctggcttttgcttgaggactttttattaaaaaaggcacctggtcaatgacggcttgacttactagcggatcatcgggtatggagccggcgaaacgcacctccgcgcctaaaaacgtgtggatcgcatgagaaaggcggttgtacgtgtccagcgcctgtttttgagcgcgggcgcgattgacggcaatgtttacggtcagccgttcatccgcgagcaaaagatgtttgatcgcgctgtacgcatccataatggccgtcggctcaggcgttgtcacggcgagaatgtcttccgccgataaaataaacggcagctgttcttttgaaagtcccgctcccatatcaaacagaacgtaatcaaaatcgcttaatacagcggaaagaccattcataaaagccgaccacttctctctgtctgcttgatagaacgcctcaagccccgttcctccggatatgtagcgaaggcctttcggaccggaggaaagtgattgagccaacgcgtgccgattctccatcacatcaataatggtgcgggaagaagcagctccgatcagcacatcaatgttgcccattccgatgtcaagatcaatgatgagtgctttttttcctttttcctgcagggcaactgccatgtttaatgttaaattagattttccgacgccgcctttaccgcttatgacggctaatgtcctcgcttttttctcataaagctccggcttgatcatttgcctctctctcattttccttcttaatgactctgcctgatcgggtttcatgccaaaagcatccttacaaactcttttggtgaagccgataggatgtcttcaggcacatcctgtccatttgtcaaataggcggcgccgattcttgattccgacagcacttgaaacacggagccgagtgaggcggtttcatccgttttcgtgaaaatgaattgattgaccggcacaccggaaaactgtttcagcacctgtttcatatcttcatattttgcagatgccgataatacgagaaaggattgtaagcctgattcaaacggaatcatctcttgtaattccgtaatatactgctcttctttaaagtttctgccggctgtatcaatgaaaacatggtcgtattcagcgaatttttccagtgccttcagacattcttcctttgaatagcatacttcaagaggagcctgaagcagctccgcatatgtcttcagctgctcgaccgcggcaatccggtaagtatccgtcgtcataaaggcaatttttttatgctctgtcagcattgatgaggccgcaagtttcgcaagtgtagtcgttttgccggccccggttgaaccgaaaagcacgacgtattttgattgaatcccttcctgccacctgtctgtcgaagggagttttttcactaacaaatcctgcagctttgagctgacattatcttcagttaaatctccggaaacaattgaagaactgagcaattcactgagtacagcgttttgcgtatgatcaggaagcccggcttgcttcaatagtctctcggctttttttaatggttcagggagcacttctttcaaatgcgccagttcgccggaaatactttgatccggaaggcgcggcggctgaacaggctcagctttctccgccgtttccgtctttttcatttcttcagcggcagccggcggcgtttttctcgcttccctgacgtcacgatctaaaaccgctatcacttcgacggcctgctgcgaccgcagccccagccattttcgtttctttacttgtttggaatgtaaaataacggcatcattgccgagttcctttttgatttgcttcgcggcatcctgcattgaagcggctgtaaatttttttattttcattaaatatccaccactccaatgctctgtacttcaacatttgcttccagctcattataagaaagaaccggaagatcagggaaataccgttctaacagctgttttacatacattctgacagcaggcgagcaaagaagaatcgccgactcctgacggatggaaagctgctcggcctctttagcgacagaacggatgatgctgtccgaaacctcagggtcgagtgacaggtaattgccctgttcagtctgctgaaccccgtctgcaatcgctttttccacccggcctgagcatgtgatgaccttcagcgtttcatgctctctcgcatattgtgccgtgatttgtttggcaagcgactgtctcgcgtattctgtcaaaaggtctgaatctgtcgttaatcttccgtaatcggcaagagtttcaaaaatggtcaccaagtttctgattgaaactttttctctcagcaatttggcaagcaccttttgaatatcgccgacagaaagagggttcggcgtgacttcctcgacaagcacaggataattttccttcagatgatcgatcagctgctttgtttcctgtctgccgaccagttcatgagcatgctgcttaattttttctgtaatatgcgtagatacgactgacgccggatcaacaactgtataccccagcatgtccgcttcatcttttgcagcttcgctgatccattttgcgggaagtccgaacgacggttcaatcgtttcaattccttcaatgacgtcatcttcaggcgtcggtgacatcgctaaataatgatccagcaggagctctcctttagcgacttcattgcctttaattttcaatctgtattcattcggctggagtgcgatgttatccctgatgcgcacaaccggaatgacaagtcccaattcaagcgcaagctgacgtctgatcatgacgatgcggtcaagaagatcaccgccctgccccgcgtctgcaagcggcacgagtccgtatccgaactcaaattcaatcggatcaatatgtaaaagctgcacaacgctttccgggcttttcagttcatccgcctgagcctcttcttcaagaatttcttcctcttcttcgctcggcttatccgctttggacagcatataagcgccgaatgcaagcagaccggcgatcggccccgtcagcagaatgccgatcggtgtaagaagaccgagcaaaagtacagttcccgcggctacatacaagagcttcggataagcaaacagctggcctgtaatatcatgaccgaggtttccttcagatgccgctctcgtcacgacaatccccgtagccgttgaaatgagcaaggccggcatttgagaaacgataccgtcaccgaccgtcagcattgtaaagtgagacgcagcttcttgtatgctcatcccctgctgcagcatgccgattacgattccgaaaataatattgatcatcacgatgatgatccccgcgatggcatcccctttaacgaatttgctcgcaccgtccatggcgccgtaaaaatccgcttcccgggcgactttttcacgtctgtgctttgcatcctgctccgtaatcatgccggcatttaaatccgcgtctatactcatttgctttccgggcatcgcatcgagcgtaaatctcgccgccacttccgatacccgctcggcgccttttgtaatgacgataaactgaataataattaagataatgaagacaacaagccctaccagcacatttccgccgacaacgaaattcccgaatgtctcaacaacctttcccccttctccgtgagaaagaatcgaacgtgtcgtcgacacattgagcgcaagccgaaacagcgtcaataacagcagcaatgacgggaatatcgagaattgcagcggttcttgcatattcattgtggtgagaagcacgatcaacgcaagagagatattaatgatgatcaaaatacttaacaaccatggagggaatggaatcaccagcattgccacaatgaggacaacacttattaaaaccgataaatctcttgttgacatgctgtttttctctccttttgaatctgaaattcgctatactttttgtttcgttttatatacataagccaaaatttccgcaatgactttgaaaaactcttccggcacagcctggtcaatgtcaacctgatcatataacgcacgcgcgagcggcctgttttcaatcgtcatgacatcgtgttctttggcgatctgcctgatttttaatgcaagatggtcgacccctttggcaacaatgtaaggggcggccattttcttttcatcatattttaaagcaatcgcataatgggtcgggttggtaatgatgacatccgctttcggcacttcctgcatcatccgcctcatcgccatttcccgctgcttctgcttaattttggacttgataatcggatcaccctccgattttttgtattcatcttttatatcctgctttgacattctgatatttttctcatagtcaaaacgctgatataaataatcaagcccggccagcagcattagagcccctgatcccgcaagccccatccaaagcgtgagcttagaaacgaaagtgagcacttccgcaggtgttaaaagcggaaggcggagaatatcgccataatgcagccagagcaccataaaggcggcaaaaccgaccacagtaatcttcaaaatggatttgaccagttcaacaatcgccctcatgctgtaaatccgcttaaatcctttcagcgggctgagcttattcaagtcaggcttgagaacttccgcagaaaacagaaaacccacctgcatgtaattgctcacgacacctgccacaagcgcgaccagcataatcggcgcgaggatgaggctgatatctttcaccgtatctacgaacagttcatgcacggaagatgctgacagatgtaatgatatcgatttcgtataaaacgttttaataaaggacagcagcctgtcccgcatataaggaccgagcgcgatcagcgaaagaaagataatcagtaaagaaacggctgtattcacatccgtacttttcgcgacctgtcctttctttcttgtatccttccgttttttcggagtggctttctccgttttttcaccggcaaagaattgcagattcagtctgagtctcatcatgtcacaccgaccaatgccaatagattccgcatggtttcaacggtaaggctgaagatgttgcggacgacgacaaacatcaccgccatacaaacgatcagcataataaagctcacggctattttcagaggaagcccgacaacgaaaacattcagctgcggcaccgttctcgccacaataccgagcgccaaatcaactaaaaacagactggccacaaccggcgcagacatttgaaaagcgataatgaacatggcattgaagctttttgcgataaaaagtccaaagtgatcatttccaaacgacggaaatgcctgatcaagcgggatatactgaaagctgtaataaatcccgtccaataaaagataatgggcgtttacgctgagcataaataacagcgccagcgtataaacgaattgtccgatcagcgggctttgcgttcctgattgcggatcaatgacattggcgatggaaaagcccatctgaaaatcaataaaggaacccgctatctgaatggctgtcatcatcatgaaagcaatcagcccgaggctcaagcccacaacggcctcttttatgacaagcagcatatactgttcccctatttctatttccggcgcatgtttcagcgtgctgaagcagatcaccgaaagaaaaaaagcaaagccgattcggtgaaccgccggcagattccgatgtccgaacaccggcaccgttacaaaaaaagcagagattctgataaagaccaataaaaaagcgggaaataaatcaatgatggaattcatttgattctaccctgcaaatcggttcagatgagagaacagatcagttgtgaacgaaagaatcgtcgacagcatccaaggaccgaaaaagatcagtccaagcatcaccgccacgattttcggaatgaacgcaagcgtctgttcctggatttgagttgtcgcttgaaagatactgacgagcaaaccgacgatcagcgcgatggcaagcagcggcccgctgatcattagtgttacatatacggctttttccgccatggaaattacaaattctgaactcacaattagcacctaccctaaaagctgtcaagcaaagatttcacgattaaataccatccatcgaccaaaacgaaaagcaatattttaaagggcagagagatcataaccggcggtagcatcatcattcccattgacattaagacgctcgccacgaccatatcgataattaaaaacggaataaaaatcataaagcccatttgaaaagcggttttgagttctgatatcgcataagcaggcaccatcgtcgtcaaaggaatatcctgaatcgattcaggttttttcattttggcatagttcataaacagcgccagatccttctgccttgtatgcttgctcatatactctttaatcggcttctcggcttttgtatatgcttcatcgagactgattttgttgtccatcagcggcgttaaggcttccttattaatctctgaaaaagtcggcgccataataaaaaacgtcaagaacagcgcaaggccgattaaaacctggttcggaggcatgttctgcgtcgccagtgaggttctcacaaaagacagaacgatgacgattctcgtaaagcaggtcatcaaaatcagaatccccggcgctactgaaaagacagtcaaaagcagcagtaatttaacagtggagctgacttcggtcggattgcttgaattaaaaagattaacgaattcattcatgatgataagggcctttcttctttccttcagaacggctttgtttcagctcgttcagctgttctttcagcgcttttgaaaacgacggaagcatcgtttgcggctttttttctccatccttacgcggatttacgagcttggtccattccacttttgaagacatcgactcttcgtattggctcagaatcgcctcgcgctctttttcatcttctatttcttttaaaagctgtatcgtttcgcccacaccgactacgagaacgctgtttcccactttaatcagctgcacggaacgattttggccgactgacgttccgccgatattttctacatattgaaacggcttcagcagacggtttcttctattcatcagtttgacaaatccatagatcagcagaatgacgaataataacgccccgatcatctttacaaaatcaaaagcggagacagaagatgcagaagcatcccctatctcttgatcagccgtttgtttcgatgtatcgctttttttctctgttttgtttgttgattgtttgtcaaaccattcgttgacggtggaattatcagactctgccgcaaaagcagggaacggatgtacattgagtaaaacgaaataacaaatcaaagctagtaaaccatgactctttttcaacagtcgtacaccctttagcttaatgttttattaatggcttcaagcacgcggtccgcttggaacggtttcacgataaagtcttttgcgccggcctgaatcgcgtcaataaccattgactgctggcccatagccgaacacatgatgattttcgcctgcggatcgatctgtttaatttcctttagagctgtaatcccgtccatttcaggcattgtaatatccattgtcactaggtcgggggaatgctctttgaatttttcgactgcctgcgctccgtctgaagcttcagctacaacgtcaaaaccgttcttcactaaaatatccttgatcatcattctcataaatgctgcatcgtctacaattaaaattctgtgtgccataatctgtttctctcctctatgttcgcttattttaaattgttaaggcggtctgcctgacttaaaatatcagtgactctcacgccgaagttttcttctatgacaacgacctcgccctttgccacgatccgctggttgaccaggatgtccacaggttcaccagccagcttgtcaagctcaataatgcttcccgcagaaagttcaaggatttctttgacgcttctcttcgttctgccgagctcaaccgtaacggaaagcggaatatccatcagcatatcaaggttattccttgatccttgcgccgcttcgttatgatcaaacgcctggaattctaccggagcgacttgaacaggagcagctttttttgcggttccctgtctcttcggaagctcgggttttgcctgcggctccggctgcatggcaggttccggctgcggcgtttcgtatgtttcctgtggttctgatgcggtttctgcggcctctgactcatgctggtccgcagtcatcaggtctgcgatcagatctttcgcaaacgtaatcggataaagctgcatgatgctcgaatcgattaattcgccgactttcagacggaatgacacttttacgagcaggtcatcctcaggtattctgtcggtccctttttcttccgtcacatccagaagttcaacccttggcggagaaatgtcaatctttttactgaatacggtcgacattgacgtagcagccgagcccatcatttgattcattgcttcctgcacggcgctcaggtggatttcaccgagtgacggatcggcgccccggccgtctccgccgatcatcaaatccgcgatgattgccgcgtcgctttgttcgacgacgagcaaattgctgccgtcaaagccttctgtgtagttcacttcaatggcaacatacggatgaggaaattcatcactgattttgctttttgaaatgacggtcacactcggtgtcgtaatgtccactttttgatttaaaagagtggacagcgccgtagccgagctgccgaacgaaatattcccgatttctccgatcgcatcgcgctcaagttcagacaagttcgcctcttgaggctgttctgtatcctctgactgactgcttgtgccgttaagaagagcatcgatttcatcttgagataatctattgttcatcttgttcacctcttatgtcgtgatctaaaatttgcactgcctgtcttcgattcacccggccggcctgccctaaaaacttcggtttgtttccgaccaatacagtaagaggatcagtcactgatttgtccagagttatacagtccccgacttccaaacttaaaaattcttctattgtcagttcagaagcgcccaagagagccacaacgggaatttgagccgtcatgatgcgcttttcaagcagcttcgtttcttcgggcttcgcttcattccggtctgattgcatccaataatgtacggaaagcttagggataatcggctcaagtacgacatggggaatacaaagattaatgacaccgctgatttcacctatctgtgtattgagagaaatgacaacgactgtttcatttggggaaaccatctgtacaaactgaggattcacttcaaattcagtcatttcagggtcaatatcagcaatcgattgccaagcttctttgtagttgcccagtgcattttcaaataagttagaaataatattcgtttcaatttccgtaaggctgtcagctttgttatgagtgatgccgatgcctcccatgacgcggtcaagcattgcgtatgcgatggtgggattaacctccatcatgattctgccttccatcggatgaacatcgaataaatttaaaatcgtcatgttcggtatggaacggataaattcttcatacggcacctggtcaactgagctgacggatatatgaatatacgttctgagcttggcggaaaagtgtgttgtgagaagcctcgcaaagttatcatgtatccgggttaaactgcgtatctgatctttcgagaatctgagagcccgtttaaaatcatatacctttacttttttctctttaacttcctttttcagctcttccgcatccgcctcacccgtggaaatggcggaaagcagtgcgtctatttcattttgggagagaacttctcctgacattttcttcacctccgtattctgtcaaatttgtttttattgcagattaaaggaggtaatgtacactttctgaacttttccttcttggagatagctgtttactttctcttttaatgattgtttaaacgcttctcttcctttatctccctcaatctctccggcgcttgtgtcagctaaaatggaaatgatgttgtctttcacctgaaaatcgcgtttttcaagttcttccttcgctttagccgagtcggtttcaagcttgatgccgatacggatgatgctgtcagactttaagtttgtcgtgatatcgtcgacagacacagtggctgcaacgacttcgtcaattgtcggctttttatctttgccggaatgtccgctgacgacaaaatatgctgccgttccgaggccggcgatgacaattaaaataatcagcaaaatgatgactaattttttcttcattcttcttcctctattccctgatccagtgaaaatatttgtatgctatggtaaaacgatatgacttttttgagaactgcttcttccggttctttcacaacgaactttttgccgttggacagtgtaatcgtcgtgtcggggaagcactcaatctgttcgataaacagcgcgttcagcgtaaaaggctggccgtttaaacgggtgacttgaatcatgcaatccggagaagcggcctaaccgcctctcctccctccttaccgtttcagattaaccagctcctgaaggatttcatctgaagtcgtaatgatttttgagtttgattggaaaccgcgctgagcaacgatcatttcggtaaattcatctgtcagatctacgtttgacatttcaagatagcctgccaaaagcttacccgttccgttttcgcccggagtggtgactgcgctcgcagctccggaacttaatgattctctgtaaaggttgcctccgattttttccagaccggcgctgttagggaacgtgaccagaccgatttgtccggcatcatgaaccgcatcccctgcatcagtgtatgtaacggttccgtctgcaccgatgctgtaatctttcgcatcagtcggaatattgattttgccgccgccgattttttcaaggtagtacccgtcagtcgtaacaaggttgccttgattgtcctttccgaaattccccgcacgtgtgtaaacgattcccgaacctgtattaatctgaaagtagccgtctccgtcaatggctaggtcggttttattctgtgtagcctgcggggcgccggttgaatgaacgacatcaatggaagaagtcgcggcacccaggccgatttgttttgaattggtcacgtttgaaccgccggcgactgtctggctgatcatatctttaaatgtaacgcggcttttcttaaatcccactgtgttgacgttggcgatgttattgccgattacatctagttttgtctgaaagtttttcatgccgctgataccggaatataatgaacgtaacatgttaaattccccctgggtttctttttatttagatgtttcgctgacggccgtgacattccacggactgacctctttgccattttcaagcacgagcacgtaattgccgtttgaatgcttgactgaattgactgggcttgtctgatccttcccgtcgctgtcgctgaatgtgacatttttgccgatccagttcacatacatcgtaaacggatcttgattttctacaaatttagtcatcgtcgtattcatattcatcatttgttccaatgaagaaaatgtcgccatctggctgatgaattctttgtcatcaaccggattgagcgggtcctggttttgaacctgtgtcattaagatcttcagaaattcgtctttccctaaattcgtactgctgtttactgcggaggtgctcttcgcgtttgaagtggttgaagcgcccgccgcggcataatccgagtttactgatgtcacctattcttcctccatttcattgagagaaagctcctccagcatatctccgaaatcgcctgactgctgcttgttcttctgctctctctgtccctgatgctgctgtttattgtgatcggccgtctgcccgtaaacaggctgctgatccccgccttgaagcgggactgtaaaacggtcgacctggaccgacatattcggaagcgactgtttcagctgaggaagatgctgttccagcagctctttcgcggactggctggatgcgattattttgctttgaaacatcccgttttcgtttgtcaccttaattgtgacaaatccgaggttctcgggattaagacgaatcgtaaagcttccggttgttttcccgaaaggcgtgtatttcatctgtttccagccgctgatgacctgatccgttaacggtttattttctgccggctgctgttcagctcctgcggacgcttgctgaatgccggcaaggcttctcgttcccgaaaacagtatatgtgcagacaatttgctgtcaggcgcctttgcgtgagaaaccgtgccgccgttttgctgttccgttttcccggctgactcttgggatgattcagatgattgagataacacaaaagctttcagctcagtttcagccatatcccattcctttgttcccttttgagaaaggcccgcaagctgctccgcgacgctttgaaagctcttcagctcagcggctgtcatggagtaaagtttagatgcagattcgtttttcggaaaaaatgtctgccgcaggtcttgaatcacgcggtccggaacaccttgttttttcaatgcctctaataaacgggcgccttcctggtaaaccgcctttgcctgcgtgctgtccggcagttcctgctgagatgtgaagagctggaatacggcttcttgaatgaaaagcaggcccttctcaagcgcatccttgacggaatccccgtcttttgcggaagaatccggctcattcgtttcaggcttcgccccatgctgttttcccgctaacatgtcttcaacggattcggcaagctgtttcaataaaggaagagctgtttcagccgtctgctttccttcaagagcttttaccgcctcaagcagctgtttaagctgcaattctttatcttccgggccggctttcagccaatcaccgattttcgatagggcatcattcagctctgcgtcacttgtttttgtttcatctccgggctgccggggagaagtgatttccgacaggagccagttctgaaatagacctaagctgtttacattcatcttcacattgctgttttgcgcagtctgcgtacgattacccgttaattcaagcagcttcaacttacatcactccttatttccgtcagcggatagtttttctgtatatttagccgcttgttcaggagtcattttcgtcaagatttcagcaagctgctttttacttaatccgtttaaaatatcgagggcttctttttctttcagctttacgataatgcttgccgctttaccgctgtccatacttttatagatgttgatcattttatcttttccggctgaatccgaagcgtcttttttcgtttcatccgtcttcgttttctgctgctgttcagcttcctgtttcagcgaacggattttctgattcagattatcgatttcggacttgcttgtatctaaatctttattcaaaatgttaatttcacttttttgttcctttatggtcttttcaagagaagccgttctgtcttccttctgcttttccgccgcgcttttcatttctttcgtttcgggaaccaattcttttaaaacaggcgttttagcggctgtttcctgaatcggcttcatcacatcaacgccggcagcccaaaggatgatgcttgcgacgatgatcagaaaaatcagcgggatcatgataaaaagcaggattgaaccgaactttccagatctcttttctttttcggccatttcattcgctcctaatgcccctgaatcataaactgcttgattgaaatgtcatccatttccctcatctctgcagctttgtcttcaagtgcgaacatattaaattgtttttcccgcattttttcaaatttctttacttcaatgtttttttcggtgagctgttcctgcttctcattcatttcatttcgtttcatgatgacaagcttttgataatgatagatggtgttctcaagattggaaacgaattgctgataatgtctcatttcctgaacgctcatcccgcatttcagctttgattctttgtctttttcgagcaattcttttttgctcatattttcatatagtttttcagccactgtctcaaattcagaaaccgattgtctgtattcagtcaatgtttggtctttttcattttcttttaattccagcagcttttgaaatctgaattggtacgccatgatgtttattcctcttttcctgtcagactcgtcaatgccgcaatgctgtcttccaattgagcaggttcttccgttccttgttttaaaaattgaataagctgcggataaaactgaatcgcttcatcaatttctcttgatgaccctcttttgtaagctccgatattaatgagatcttcagagttttgataagttgacagaagatcgcggaatttgttggccgcctctatgtgcgctgtgtctgaaatattagacatgaccctgctgatgcttttcaggatgttcacggccgggaactgtcctttgttggcaagcgcccgatcgagaacgatatgcccgtctaatattccgcgcaccgtatcggcaatcggttcgttcatgtcatctccgtcaacgagaaccgtataaaaagcggttatcgttccttgttcatttgcgcccgttctttccagcaaacggggcaaaatagcgaacacagaaggtgtatatccctttgttgtcggcggttctcccgctgccaggccgatttcccgctgagccatcgcgaccctcgtgacggagtccatcatgaacatcacattccggcctttatcgcggaaatactccgcaatggcggtggccgtatacgccgctttcaatcgcattaacgcaggctgatcagaggtcgcgactacgactatcgagcgtttcaggccttcttcgcctaaatccttctcgatgaattcacgcacctcgcgcccccgttcaccgacaagtgcgataatgtttaaatcagcttcagtctgcttcgcaatcattcccatcaaggtgctttttccgactccgcttccggcaaaaatcccgattctctgcccttttcctaccgtcagcagactgtcaatcgatctgacgccgacacccatcttttcccgtatcggcgggcgtttcatcgggtttggcggcggctgttccgtcgaaacgggggacaaacctttcggaagcgcccggccgtcaagaggttcgccgaacgcgtcgacaacttgtccgattaaacccgcccctactttgatgcggagcgactcgccagtggcctccacaatgctgcccggcgctatgctggccgcttccagataaggcattagcagaatgttttcatcctggaagcctacaacctcagctttaatcgcttttttcgcatggcctttcggataaatgagacaaacatctccgattgagctttcgggcccttttgattcaatcatcagcccgatgacccgtttaaccttgccgtagcgtttgtacggatccgctgtttcaattgagtctattaaatactgtgtcttcattgctccgctcccgcctcaagcgccgttaaaagcttttgctttaattgcatcagctgagtgtctatgcctgcatcaacacgtccgaacggagtttctatcgagcacgttcccttcgcggctttttcatcggcatataagcttaatctgcattctttgtataacagctgctgaatttcgtccatatgctgatgaaccgtctcataatattcagggtccacatagatggagatgtcatcataatcttttacttcggctactacctgtttgaccagcagaaggaaagcctctttatcgtcacttttttgccgccatacttttttagcgagcgcaacagaaagctcaataatttcttcctcagcgctttccagtttttcctcgactgattgtctggccatttccataacggcattggcccggctgatgagattggcatattctgcttgagcatcggcttttcccaatgccatgccttctttatatccttctgccttcgcttcttcaatcaatctttgtttttcttccgcccagcggtttttctcttcttcaatctgccgaagagtgtgatccaattgacttttcgcttcttcagacaccctgtcggcttcggccttggcaaaggccatgagtgcctccggattttcaggttcctcccggtctggctgggaatgtgttttcctgacttcctgcaaggatagcttgcgccgtttttgttcaggagaaaatgatgtttgctgtttaatgatattagacaataatatcgtctcctccgcctcgcgcgattacaatttctccggcttcttccagcttgcggacgacgcccacgattcttgattgcgcctcttccacatcacgcaaacgcacaggccccataatttccatttcctctttaaatgtttcaaccatacgctgtgacatattgctgaagacaatctctttgacttcctcgctcgcaaccttcaatgaaagcaggaggtcgtcgttttcaacatctctgatcacgcgctgaatcgcacggttatcaagggtgacaatatcttcaaagacaaacatccgttttttgatttcatccgccaattcaggatcttggatttctaatgaatcaaggatcgttttttccgttcctctgtctacgccgtttaacacttcaacaacggcttctatgccgccggtctgcgtataatcctgcgtaaaggaggaggacagcttttgttcaaggacccgctccacttcatttatgatttcaggagacgttctgtccataaccgcaatccttcttgccacctcagcctgaacgtccgggttcagctcagacaaaatctgtccggcctgcaccgggtcaaggtaggataaaatcagcgccatcgtttgcggatgttcctgctgaatgaaatttaaaatctgttcgggctccgcttttctcgcaaaatcaaacggctttacctgcaaagaagaggtgagcctgtttaaaatgcttaccgctttgtcttctccgagcgctttttcaagcacttggcgggcgtaatttaaaccgccttgtgaaatatagtcctgagcgattgcgatattatgaaattcttcaatgatttcatcttttctttgatgatcgacgcttctgactcccgaaatctcgagagtcaacctttcaatttcttcttcagacaaatgcttgtacacagaagctgatacatcaaggcctaaggaaatcatgaggatggctgctttttgttttcctgtaagcttgttctgatcacgtttcgccattttccattccccctaatcctcgtccagccagcttcgaagcaatttagcaaagtcttccggtttttctttagccattttttcaagctgttttcgtctgactgtttcttccgtttcaattttctcttcgttgatatcaggcaatcgaaccggctccggcggtgtttcatattcatattcttcgtattcatcctcttgtgagcgtttctttctgatgaggagaatgataagcagaataatggccgcaagcagtacgccgcctgtaatatatacccagatcggaagacctgaagattgtgccgaatctgtgttcaggcttgtttttccgtcaaacggctgaacggatacaacgattttattgttgatatcattgtctgtcaggttttgattttgcgtttcgtttttatcaagagacgttctgacgaccgttcctaaaatcttctgtatatcagcctgtctctgtgccgataaggaagcggcatttttcggattaggcggctccaccatgacctgaatgcctaaatcacgcactttatacgggctttccgcgatttctttatgaatgcggttgacttcatagttgattttattgctgcttttttcgtagtccccgctgtttgaaccgccgtttgtctcggcatagttcgcggtgtcattgcttcccgttccggccgtgccgccgttggccgcgccatcgcctttatacgtttccgcgactttttcggcgcttaccgctatgccttccatgttatctttatcgacaggttcgacagtgtcttcagtgcgtttttccttcgtgaagtcaatatccgccgttacagaaacaacgaccttatcctgccccatcattgtgccgagcagtgactgaacatgtttttgaatgtccttttcgacctgcgacttaataccttgctgagatgcataactgtcagaaacggaccctgcaccgctgtcacttttgtcataatatgtagaattttgatccattatgacgatattatcttcttttaagttcggaacacttttagaaacgagatggtacagcccgttgatctggttttgatcaagcgagtagcccggtttcatctgcaaaacgatggatgcggacgctgccggctgatcttcaccgacgaacacggcttctttcggcatattgatcatgaccttcgagcttttaataccgtccatttcatttatcaggtttgacaattcggtctgagtcgcctcaacctttaaaacgtcaaactcattatctgtcaggccgaagcccgcattttgtccgaaaaacgaataatcaattgatcccgttttcggcaggccttccgcggcaagctggactttaagcgaatccacttggctctcaggaacctttatgaccgtgccgccgtcagcaagttcagaagacacctttttcgtatcgagctcttctttaatcttccccgcttcttccgcggacaaatctttataaagaggcaccatcttttcagacgaagtaaaaataataacgacgatgagtaaaataatgaatgcggccaagccgcttaccatgagtatcttctgtgtttttgatctgttgttccaaaacgctgccgttttggttttcatttgcattagagtacgattcatgttaacccccggtcattccagtcattctcttcaatctgaccactacatctgcattctcatgatttcctgataggcttccacggctttattgcggaattcggtagcggccgtcagagaaatatttgctttttgggcagcgatcatgacctcgtcaaggtttacatcctttcctgcagccagttcgttcgttatttggtcagattttacttgtgactcatttaacgaatcaatagagttttttaaaagctccgaaaagcttgtttggtttgaagaatcagttttttgagtttggtttaattgattcgttacgttttgagtgttttgggtttgttgaagctgaaaaggagtaatagcgttaaccacttacatcaccttactttccgatttctaaagcctttaaaagcatgcctttggaggcgtttaatgcagttacgtttgcttcatatgatctcgtgctgctgacaagatccaccatttcttttaatgggtctacatttggtttttgtacatatccgtctttattcgcatcaggattctccggatcataaacgagattaaaagcggacgggtcttccgtaacgccagatacctttacgccatttcccgcgcttcctgttccgttcatcttggaatgtaaaagggacgaaaatgattcgcctccggattggagagataccagctttcttctgtaaggcacccattcgccatttacctgcttcgctctcgttgtgtccatattggccaggttggacgatacgacgtccatccggacacgctgtgcagttaaagcggaacccgaaatatttaagctttgaaagccactcattattttcctcctgtcaagacggttttcagagaattgaatttgccgctcattctttcaaccaaagcctgataattaatttggttttcggctaaatctgtcatttctttgtcgatatcgacattgtttccgttttgctggtacgatgtatcactgctggacacgatagaataatcgtcccttgaacccgtaaagtcaacgtgccgatagtcggtttttaccgcctcaagattggatgtttcctgatctaacaaatttcggaaagagactttttttgccttatagttcggtgtatctatattggcgatgttattagttaagactttttgcttaatgtccgctctccccaaggcattctcaagattttgtatagttccagaaaataagtccaaatccacttacctccatttcagatatttttctcctaaaaatccttgtcgagaattgtaaaaccatatgcttattgtaagaaataacaggcttaaagtctatgaagttaggctaaaaaaaagtgctcaattatatctattttgcatgtaggtattaagtcctagagtatttggactacaagtatttgtttaatataagactgaaaatagcagaatttctgtatcttcctccttttttcacacagcaagatggattatctcagatcagcttccaataagcaactttaaactgcaacttttcacctattgtccataaaaaaagcaggacccccattttcagggatcctgcttttgtcttaatgagatttaaggttttccaattcaataaggaatttgttgttcagaactttaatgtacgtccccttcatacccagagatctggattcaatgacgcctgcgctttccagctttctcagcgcgttaacgattactgaacgcgtaatgccgacacggtctgcaatcttacttgccacgagcaagccttcgtttccgtcaagctcttcaaagatatgctcaatcgcttcaagttcactgtaagacagagaactgatcgccatttgaacaaccgctttgcttcgcgcctcttcttcgatttcttccgctttttctcttaaaatctccattcctacaacggttgctccgtattcagcaagaatgagatcatcatcttcaaattgatcctgcagacgggacagaatcagcgtgcccagtctctctcctccgccgatgatcggcacgatcgttgttaagcccgcttggaacaggtctctgttttccacaggaaatgccgtgtattcgctgttgatatcaaggtttgaagacgtctccggaacattgaacagatttctcgtgtactcttccgggaactggcggtcttcaagcatttttttcatgcggtcattttcaatctgctgattaatagagtagcccaaaagctttcctctgcggctgacgacgaaaatattagaatcaatgacgtcacgaagcgtttcagccatttctttaaagtttacgggtttgcctgccgcagcctgcagcatgctgttaataattcgtgttttttgtagtaaagccatgataaataatcctcctagaattcctcttattaaattttcacaatataaattgacttagatctttgttgtttgcaatcgttccgagcttttcttcaacatattgcggcgtgatggcgactttttccatcgtcacgtccggcgcttcaaacgacaggtcttccaagagacgttccaatatcgtgtgaagccttctcgctccgatgttgtccgtatcctgattcacatgataagccacttcggcgatcttacgaatagcttcgtcagaaaattcaagagatataccttctgtctgcaataaagcctgatattgttttaacagcgcgttatcgggttcgacgagaatcttcacaaaatcatccaccgtcagcttgctcaattctacacgaatcggaaagcggccctgcagctccggaatcagatcagacggtttggccatatggaatgccccggctgcgataaacagcacgtgatctgttttgacggagccgtatttcgtgacgacggtagatccttcgacaatcggaaggatatctctttgaacgccttctctcgatacatctgctgaggaagaagcccctccgttttttgcaattttatctatttcgtcaataaagataatgccgccctcttcagctcttaacacggcctcttggccgacttcatccatatcgattaatttgcctgcctcttcattggtcagaaccttccttgcttctctgaccgtcattttgcggcgttttttcttttttggcatcagattgctcagcgcatcctgcatattcatgcccatctgctccatcccggagccttgcagcatgtcaaacatcgacggctgctgctcttccacctctacggagacgtaatggtcttcgagctctcccaatgcgagctgatgcgccatgcgttttcttttttcttcaaggcttgcttcttcctgctgatcggcttcatcatcatttgccgtctgacttcctccgaaaagcatttcaaacggatttttcacacccgcttgttttttctttcccggaacgagaagccgcacgatacgtttgtttgcattttcttcagcctgttctttcacttcgctgattttttcttctttaatgagccgcacggatgtctcaacgaggtctctgaccattgattcgacatctctgcctacatagccgacttctgtaaattttgtcgcttcaatttttataaatggcgcaccggtaagcttggcgatccgtctggcgatctctgttttccccaccccggtcgggcccatcatcaggatgtttttgggaacgatctcgtctctcagtttttcatcaagaagacttctgcgatagcggtttcttaatgccacggcgacagcttttttcgcatcctgctgtcctacaatgtattgatccaaccgatctacgatttgtctcggtgttaacggtttgttttccatgcgcctcaagtcctttctattcaagttcttccaaaatgatctgatcgtttgtgtacacacaaatctcgcctgcgattttcaaagcggcttttgcaatatctttggcggacagattctctccggcataggttttcagcgctcttcctgctgacagggcgtagtttccgccggagccgattgccaaaattccgtcatccggctcaatcacttcacctgttcccgatacgagaagcaaggtatcctggttcatgacaatcagcatggcttccagcttgcgcagcactttatcgctgcgccattctttcgcaagctcaaccgacgcacgttttaaattgccgttgtattcttcaagcttcgcctcaaacatttcaaaaagtgtgaaagcgtctgcaacagatcccgcaaatccggccagaacctttccgttaaacagctttctcacttttctcgcggtatgtttcatgactacagcctgaccgaatgtgacctggccgtctcctgacatagcgcttttcccgttatgctggacggcaaaaatcgttgtcgcatgaaaagatgacatgagaagggcctccttttaattttctttaaaagctctcgggtggtgggacatatatgtgtttctcagcatttccttcgatacatgcgtgtatatctgcgtagaagacagattggaatggcccaaaagctcctggacgcttcttaaatcagccccttcattcagcagatgagtcgcaaacgtgtgccgaagcatatgcgggtgtatatgtaaagtgccggatgctttttttacaagcccgcttaaaatataccggattcctctggcggtcagcgggccgcctctttgattgacaaacagcacatcatgaggctcttttgctttttcaagcaggcactgccttccgctgttgatatacagctccagcgcatcacgggcatatgagccgaacgggatatagcgctgcttcttgcctttcccgtgaacgagcaccgtatccatgaacaggtcaagatcgccgacagtgagcgtacagcactcactgaccctcattccggtcgcataaagaagctcaagcagggcctgatcgcgcatccctgacggctgacttctgtctgagacagcgaatagttcctcaagttctttttcataaagaaacttcggaatccgtttctcttgtttcggcagatgaacaagctgaaacggattctcttcaacaagcttttccctcattaaaaatttatagaagcttctcaaagctgaaattttcttgctgattgttcttcttgacaggcctttttcataagcctctgtcaaaaatattctcacatcatgatatgcagcttctttcattccatttatattttgagcatgcagaaacatcccaaattcttcaatcgaattaacataattcacaatagtatattgtgaataatttttttcaatttgtaaatattcaacgaataactttaaaaaaaagttaacattctcagtcattatgaagacctccctctccgaagggcttttaaatggtatcatataatgcatcgaagttgcaatgaaaagctatatcgttttcgaaatagtttgaatagtctcaattgcgcgtttagcgtattcttcatttcgttcttttttgtttttaatttttacaggcaattcttttaagaggccgaagtttgcattcatcggctggaagttcttctgatttgtcgtcgtaatgtagtgagccatgcttccgatcgccgtctcctgcgggaatgtcacaagatcctgaccgagcacaagtttggcggcattgattcccgctacaagacctgaagcggcagattcaacataaccctctacaccggtcatttggcccgcgaaaaacagatcgttccgctgtttaaattgatatgtcgggttcaaaaggctcggcgagttgataaatgtgtttctgtgcatgacgccgtatctgacgatatcaacattttcaaggccggggatcagtttcagcacttctttttgatctccccattttaaatgtgtctgaaaacctacaatattataaagcgttcccgccgcgtcatcctgtctgagctgaacgactgcataagggcgcttgcctgttttcggatcttccagtccgaccggtttcatcggtccgaacagcatcgttttcttgcctcttttcgccatgacttcaatcggcatgcagccttcaaagaagatttctttctcgaattcttttaaaggaaccgtctcagccgtcgtcaatgcttcatagaaacggtcaaactcttcctctgtcatcgggcagtttaagtatgccgcttctcccttgtcataacgggattttaagtacactttatccatatcaaggctgtctttttcgacaatcggcgccgccgcgtcataaaaatacagatactcttctcccgtgagctctttcagctgctgtgaaagcgattctgatgtaagcggtccggtcgcgataaccgtcgggccttccggaatctctgttacttcctcagtaagaaccgttacgttcggatggtttttcacgagatccgtcacgctttgcgcaaattcatggcggtcaacggcaagcgctccccctgccggaaccgagcatttatcagcagattgaatgattgctgagtcaagcgcccgcatttcttcttttaatacgcctaccgcattggcgagtgtatttgaacggagggagttgctgcataccagttcagcgaatttatcagtatgatgggctgccgtctgcctgacgggccgcatttcgtatagttttacttgaattcctcgttttgcaagctgccatgccgcttcacttccggcaaggcctgctccgattacattaactgtttgctggttcatttcttttcatctcctgttgtttgtcccttccacacaaagaaggtgagcaaggctctgctcaccgctacttctgtggttcttccttataatcgcattcgacgcattggacttgtatgccttttttaagctttttctctacgagcatattttcacatttcgggcattttcgttcaatcggtttgtcccaagatacgaagtcgcattcaggataacggtcacagccgtaaaagacgcgtttcttttttgattttcgttcgacaatatttccttcatggcacttaggacattttacgccgatttgtttaacaatcggttttgtattccggcagtcagggaagttggaacacgccataaatttaccgtatcggcccattttataaaccatccgggagccgcataattcacaatcttcatctgcgtattcaggttcaatttccacttctttcatttcagcttccgcttttttcacgcgtttttcgaaatcggtatagaagctgtcaatgatttgaacccattctgtctcgccatcttcaacatggtcaaggtccctttccattttagccgtgaattcaacgttgatgatttccgggaaaaactccatgataagatccagcacgatctgcccaagctcagtcggcacaaaccgtttattgtctaatcccacgtaaccgcggcgctggatggtgtcaagagtcggcgcatatgtcgaaggacggccgatccccagttcttcaagcgttttaaccaggcgcgcctctgtgtaacgcggaggcggctgagtaaagtgctgctcaggctcaatatcttttgataaaaccgtgtctccctctttaaggtccggaagcatgcggtctttttcttccagctgatcgtctttaccctctacatagactttcatgaagccggcgaatttgactttacttccgtttgcccggaatgtcaatccgttattgctgagatcgacgctcatcgtatcaagtacggcaggcgccatctggcttgcaacaaaacgctcccaaatcagcttgtatagtctgagctggtctcttccaagcaccgcttttaagtcggcaggttttctgagcaccgaagtcgggcggatcgcttcgtgggcatcttgagcgttttcatttttctttgccggtttccgttttcccgctaagtactcttttccgtatgcctgatcaataaaagctgacgcctcttcaacggctgtattggaaatccgcgttgagtccgttctcatatacgtgatgagtccgactgtcccttctttgccgagatcaattccttcatataattgctgagcgatcatcatcgttttcttcgctctgaaattcagcttcctggcagcctcctgctgcagagttgacgttgtaaacggcagagcgggatttcgtttgcgctcttttttcgtcaccttgtcaactgtatacttattgcctttcagctgagcaaggacggcttttacgtcttcttcgctttttaaaggaagctttttgccgtttttcccgaaaaatccggcttcaaacgtctcttttccctttaaaaatgagccggtaatcgtccagtactcttcaggtttaaagtcattgatttccttttcccggtcgatgatcagccggagcgcaacggattgaacacggcccgcactgaggcctttttttacttttttccaaagaatcgggctgattttgtatccgacgagtctgtctagtatgcggcgcgcctgctgcgcatcgacaagatccatgttaatcatgcgcggatgtttaaatgattctttaatggcgtctttcgttatttcattaaagacgacccggcagtccgagctgagatccagatcaaggctgtgtgcgagatgccatgcaatcgcttctccttctctgtcggggtcggccgcgagatagactttttttgctttctttgccgctgtttttaattcttttaaaacagggccttttccgcggatcgtaatatatttcggttcaaagttctgttcgatgtcaactcccatttgacttttcggaagatcccggacatgtcccattgaagctttgactttatatttcttccctaaataacgttcaatcgttttcgcctttgccggcgattccacgatgactagataatcagacattttcatccccctcaagaggtgttctctctcttttcaagtatcaattcattttagagctgcctttttatggctttcaacatttcattctttatgatgaacgtcattttatacatgaaaataatatgcaactttaaatcctcactattattaaatattacaataccgtttgtcaaacgatatttcaaaagggttccgtatactgaacgcatcgggcggtcagctctccgtcaatatcctctgcgcataatacagctttcgccccttcttgaatgagttttataggtcctccggaatatggattaaatatggaacccggaacggcaaatacctctctgccttgatcgagggcctggtaagctgtgattaatgaaccgcttttttcttttccctgcacgaccacaattccttcacttagtccgctgattatgcggtttctcatcggaaagtgccattttttcggctttgtttcaggaggatgttctgagagtaggagatggtgttcagccatgtattctgctaacaggagattttcccggggatagatgtgatggaatccgccggctatcacgccgatcgtaagcccttttgccctgatgctcgccttatgagacaaaccgtctataccggatgcaagcccgcttacaatgacccagcctttttttgagagttcggcggaaagatgcccagccgcttttattccgtcttccgtcggtttccgcgttcctacaatcccgatttttctgcctttttcaagaagcggtgtgttcccttttgcatacaagacagccggcggatcataaatcgctttaagccatgttgggtagcagcttgatgaaatcggaataacagtaatgccttcgcggcggtaatcggacagaacttcatcaagttccggatccttgcgctctatttcccgaaaaattgcttccggggctgttttcccctctgataaaacagttaatggatgcggatccgaaaaaaaagacagagagtgatcagctttccaccattttaatagaagagacggggaaatgatttgattaatactgcagaccattaaacagcgcgatgcttgatccaaatctggcaacctcctcttttttcagcaaaaacaggaacagccgttacggctgcccctgcttcgatcagtgcgttttgcacgtttcaaataagcctttttcttttaacaccttaatcagcgtttcacccattacagaaggggtttccgcgacttcaattccgcaggcgttcatcgttttgactttttcttctgccgtgccttttcctccggagatgatggcgcccgcatggcccatgcgttttcccggaggcgcggttttaccgccgataaagccgacaacaggcttcgtcatgttcgctttcacccactcagccgcttcttcttcagctgtgccgccgatttctccgatcatgatgacggcatgtgtttcaggatcttcattgaacgcttttaacacgtcaataaagttcgtgccgttgaccggatcgccgccgattcctacagcggtagactggcctacgccggcttctgaaagctgatggacggcctcgtatgtcaatgttcctgaacgggatacaacgcctacatgaccctttttatgaatgtatcccggcataatgccgatcttgcattcttcaggtgtaataacacccgggcagttcggccctattaatctcgttttcttgccttccataaagcgcttcactttcaccatgtccaaaaccggaatgtgctcagtgatacaaatgacaagatcaatttccgcgtcaaccgcttccataattgcgtccgccgcaaacggagccggcacgtaaatgactgacgcatcagcgcccgttgtatgaaccgcttctgcgaccgtattgaataccggtacgccttccgcttccgttccgccttttccaggtgttacaccgccaacgatattcgtgccgtattccagcatctgctttgtatgaaataaagcggtagaacctgtaatcccctgtacaataactcttgtatctttattgataaaaacactcattatctggtcccctgcctttcattctttcctaaactaaggatacgattttctgtgcgccgtctgccattgattccgcagatgtgatgtttaagcctgattcattcaggattttctttcctaaatctacgtttgtcccttcaaggcgcacgaccagcggcaatgtcaatccgacttgtctcgtcgcttcaacaacgccctcggcgatgacatcacacttcatgatgcctccgaaaatattaacgaaaattccttttacgttttgatcggaaagaatgattttaaaagcttccgtcactttttctgcggttgcgccgcccccgacatcaaggaagtttgcaggttctccgccgtagtgtttaatgatatccattgtagacattgcaagacccgcgccgtttaccatacagccgatatttccatcaagggaaatgtagcttaaatcgtattttgacgcttcgatttctttcggatcttcttcatctaaatctctgtattccataatgtctttttgtctgtataacgcattgctgtcgaagttcagcttagcatccagcgccatgacgtttccgtcccccgtaacgacgagagggttgatctcggcgatggagcagtccttctcaacaaatgctttatataaaccgagcataaatttagcggctttgccgacaagctctttcgggatgttaattgcgaatgcaatttcccttgcctgatagccctgaaggccgacagccggatcaattaccgcttttttaattttttcaggtgttttttccgctacttcttcaatctccgttccgccttcttcagacgccattaaaacgattcttgaagtagcgcggtcaagtacaagcccgacatagtattcctttttaatatcgcagccttcttcaataagtaagcgttttattacttgtccgtccggacccgtttgatgtgtgacgagcgtcttgcctaacagttcttcggcatactctttcacttcatcttttgtttttgcaatctttaccccaccagctttgccgcggccgccagcatggatttgcgcctttacgacataaaccgagcttgacaggctctctgctttttcaactgcttcctctgctgtaaaagccactttaccttcaggaacagacaccccgtattttctgaggacttcttttccctggtactcatggatattcatttcccatcctcctaacttatgtagcaaaactaaaaatagactgcgctttcattctatataatactggaagaattgtctagggttcaaaacaaaatctttatatccttccaaacattctaacttttattttattgaaaatataaatttaaacggagtccgggaaatgaatggtccttatttttcgtttttcagggttttgtccagtctgtaaacaaatgaaaaaatttcggcaacggtttcatagagcgcctccggtatgtgatcgtcaaccgtcaaatggcgcattaattcgacaagggttctgtcttcctgaatggggaccccagccttctcagcttcttttataatattttccgccacgtgccccctgcctgttgcgacaaccttcggggcttggtctttctgccggtcgtaatgcagggcgacagctcttcttaacggcgtttgctctttcatattttcacatccacttttcttccgccgtctttttctataaactcttccacaagagcgctctggtctttcgggcgccgttttttagacgtgacgcctgacaggctgaagcccgtttcttttacggcttcttttaaagccggtacgagagggtcgatggccgcctgaagctcaaaatcagtctcaaccgtaatggtcattacattttgctgaatcacgcagtccacaacggtttcttgcagtgtttcaagatgcagcaaaaacaggagcctgcaatgtgacggatcgagttttccgtccggcttcttccgtcctttaaagagaactgtgatgtcattctcatacgcggacgctcccagcggaaatgacagcaccatctgcgtaaaagaagggttatgctgctcaataaacagctggccgtttaatttatgaataagcggttccgcctcttgtttaacggattggggcgcttcttgaagcgtccggacggcttggagggccgttttcagcgcttgtttctccggctgcggagatacgcctttttcaagcgctgtaatgaatgataattcatcacgcgtgcccaatccttttttgattttctgcaaaaggcttaatacatcatgtttttccgcatatttcaattcggtgagctgaacggctttttcgaaaacagccgcctcctgttctgtcagatgtgctttttgaagaacaggtgctgttttaaatgttttttcttgagaaatgaaagccttaatgatctccgccgttacttttacggggcggttttcagttttttctgccgatgtcattaatttctctataatctgttttgccgttttttcaggaagtttttgatctgtccgcgcactcggaggagaaggttggcttgagactgcctttccgttttcacgagtctctcggacaaatggtgattgttttgattccgtccgttcttcttcatccatcagcccggtttctgggatcggcatgcgtgcagcctcggcaagcttcttcaagagacgttctgcatgaagatccgtttccgcgtttaatacgtcagaaaccgcctctttgagcacagacagctcttttgccgattgcggtgcctgattgattgcctgaagcagtcctgagaggaggcgccgggtcggaaccggatatttaacggcatgaatggctgacaagacttccggatgtgcgggcagttcccgtttcagcgcaaatacgattgtttccgccgcttttttcaattcggcggccggaagcgattcagcccagcggacgcaggctttgaggctgttttccgtcatcggcagcttctgctgcataaacgtttcggcaatctgcagagacacagggcccggtttgacggaaagagcgtttaacagtctacccgccgcttcctgaacggttttcgggcttccttcgaattggtcgatgacatgaagccggcccgttttttccgccggctgtttgtcataagaaaaccagtaatacgcctgcggacgaagggcggtttcaagttttccctgcatcgtccggccgccgatctggataagagcgctttgatcgtccagcaaacggagaaccttccctaacagcagcctttgagtaccgctgtctttaccgccgtcctgccggtccggagggatttccgccgtcagctgtctgaaagccgcttggatttcgccgctaatgttcatgtcttaagcctcttttctaacaataagattgaacgggagcgaacgtttttcggtgaatagttgtcggtccgtatgcctgaagagcttcaagatgttctttcgttccgtagcctttatttttttcaaagccgtacatggggtaagttttggcgtactcagccatgagacggtcccgcgttacttttgctatgcaggctccggcggcaattgacacgcttttggcatccccttttataactgatgactgcggaatgtcaagcggaagggtcatggcatcaacaagcagataatcaggtgtttccgttaaagcattgacggcttttaccatcgccagtctcgcggcctcataaatgttgatccggtcaatgacgtccgcatggacaatgccgactcctacagccgccgcttcttccgtgatccggctgtaatactcctcgagcttcttttccgacaatttcttcgagtccgtgagaccgagaatctcgcattctgccggcaaaatgacggcgccggcgacaaccggtccggcaagcggccctcttccggcttcgtcaacacccgcaatcaggcggaagccctttttggatgacagtctttcgtatgccgtcatgtccagccattgctctttaagagctttttccttcgcatgctttttcagccattgctctaaaagcgtctgtacgctttttctcgggtctttctcacattgggcaaggaaggggtcgctttcgtccctgatctcttgcaggcgttcttttacgctttttacggttaatgtattcacgttctcttctcccttacattatgtatatcggtattctgcggaaaaaataaagacccgcatcgctgcgcgtctttattctgatggtgcttcaaatgaaagcctgccgaatttttccgtccggatgtcccgaatgataacttccgttgttttatcatagtcaaccattccgccgcccatcaaacagccgcgtttttcaccgatcgcgtcgaaaagagcggcgatatcctcagggatttcctgaagtccgtagcgctccttcaaacggtcgggataatgctcttccagaaagcgcagcccgaaaacagccacatcctgcaggttgataatcgtatctttaatcgccccggtgatcgccaggcgcaagccgacaagctcatcttcaaatttaggccataaaattcccggtgtatcgagcagctctaattccttgcctacctttacccactgctgtgaagtggtaatgccgggcctgtctcccgtcttggcaatgttttttttggccagccggttaatgagcgtagacttgccgacattcggaatgccgatgattaatgcgcggattgctctcggcctaacaccttttgctttcattttatcgaacttatccttcagcagctctttcgaggacggcacgatttgatgcagtccctgcccgttaacggagtttattgaaagagagggaatgccctgttcctgaaagtggtccttccactgggcagtcacagccgcatccgccttatcggctttatttaaaagcataatgcgcggcttattttttaaaatctcctcaatcatcggatttctcgatgacatcgggattctcgcatccaccaattcgtatacgatatcaattaatttcagtttttctgttacttcccgtctcgctttagccatatggcccgggaaccattgaatggtcatgtgacttcgacacctgccttatttaccggaaccggatgttccgatgatctcttatgtattttacgttgcttgttccgcttttacaaatttcatataaaaaaagagcctgttacgggtaacaagctcttttcgttcgttatcattatcgtctgatttctttaatacgagccgcttttccgcgaagttcacgcaggtagtaaagcttagcgcgacgtactttaccgtaacgtacaacttcgattttcgcgatttttggtgtgtgtacagggaatgtacgttcaacgccaacaccgtaagaaatcttacgaactgtgaacgtttcgctgattccaccaccacgacgcttgatcacaacaccttcgaagatctggatacgctcacggttaccctcaacaacttttacgtgtacacgtaaagtgtcaccaggacggaacgcaggaagatcagtgcgaagctgttcttttgtgatatcttgaattagtttttgcatcgttttcaactccttccaacagatgctcttggccacaactgcaaggcacagcggaacatcgttttcaagcttctgaaggataagcctccttaagccacaagtagtatcttatcatatcttcatcacctgcgcaatagaatctattcgttttcccactcggaaatccattttctttgctcatcagtgagaggatagttttcaagaagatccggacgtcttaaaaaggttcttctgattgattctttattgcgccattcttgtattttggcatggttgccggacaaaagggtctcaggcacttttaagcctttataatcggctggcctcgtatagtgaggatgctctaaaagccccgtgctgaaggaatcctccacgtgggatgcttcttttccgaggacgcccggcaaaagcctgacaacgctgtcggcaatcatcatggcagggagctctcccccggtcagcacaaaatccccgatggagatttcatcagtgacaagatgttcccggatccgttcatcatacccttcataatgcccgcaaataaacatgagatgttcctcttccgccagctcctcggctttcttctgcgtataacgctcaccttgcgggcagacgagaataatgcgcggcttggcgtccgtaccggctgtcagcttttcaaccgcatcaaatacgggctgcggctttaacaccatcccggctcccccgccgtacgggtaatcatcaaccgtttggtgtttattatccgaaaaagcccggaaattgatgacgtcaaaacggacagcctctttttcctgtgctttttgcagaatggatgagccgagcaccccttgaaacatttcgggaaacagtgttaaaaagtcgattttcattcgtctattaacccttccattacatgaatcttaattttcttctcatttatattaatatccttcaccacagaagctatatacggaatgagcgcatcttttttgccttttcttgcaaccacccatacgtcattagccccgggcgtcaagatttccttcactgtgccgatcagttccccgtcttctgacacaacctcgcagccgatgatttcatgaaaataaaattcatcttcttcaagctctcccaagtcttcttcaggaactttgatcaccatgtttcttaggtgttcgacttcattgagactcggcatttctttgaattgcagcaggtgaaactgcttgtgaagcctgtgggcgctgaccgttactttgattggctccgcagccccttccgcaaacaaatagagcgtattgccgggcttgtaccgttcttcggcaaagtccgttttagaaatgacccgcacttcgcctttaatgccgtgggtatttacaattttgcctacattaaaccatctgtttgtcatattatcacctcgggcggatttcaattactaccccgtcttttatgacgatggtatttgccgctgttttttcatgccagttatcaccgacgttgattgaaagcagcgcatcgatctccttttccttcacttcgcttccaagcgggagcgactctgtctggcttatttggaaatcaatcattttgattttatcttgtcttttttcaatggcttttttaaaagattccgctacatcgggattctgctgatctttttcatgttttctaagctgaaaatagagctggctgcattctcgttcaagcgtttgctttttttctgcaaaagaggccaaaagcttttccttgctttgctcggtcagaacctgcataacggttaccctgtgaataatctgcataggaccagactccccactcttccaacatatttctgttcatttgccttttttacgtgtaaaaaaaggggaggtgccggccctctccctttttcagtcaaatatttcaaattgaactttcttagaagactgtgcgccagctgcaaaaacgacggttcgaatcgctcttgcagtccggccttgctttccgataatcttaccggtatccgacttattgacagataagcgtagcgcaatcttttgatcagtctcttcctttgtgaccgttatgtcttccggatggtcgacaagcggagccacaatgctgacaatcaaatcttccaagttctgatcagtcattacttgccttgtttagcgttgtggaatttttccataattccttggcttgagaacaagttgcggactgtatcagaaggtttagctcctgtttgaagccatttaagagcaagctcttcattgattttcacttcagccggctttgcaaccgggttgtatgtgccgactgtttcgatgaaacggccgtcacgcggtgaacgagaatctgctacaacaatacgatagaaaggagatttttttgctcccatacgttttaaacgaatttttactgccattttactagcacctccgaaaatatttcaacaagatagtatattaacaatgataaaagtgtttgtaaagtgttttttcttaacaacggttttatcatgtataaccgattacataaaaggtaatttaaagccttttttcttcccttttgacatgttggtcatctgcttcatcatttttttcatttcctcaaactgctttaaaagacggttgacttcctgaacggatgttccgcttcctttggcaatccgcttccgccggctggcgttaataatatccggctgttctttttcaagaacagtcattgatttaatgatcgcttccacatgattcagctgtttttcatcgacttggatgttttttaagcctttcattttgcctgctccgggcatcatttgcagcagttcgtcaagaggccccatgtttcggacctggccgagctgctccagaaaatcatccaatgtgaagctcatcgttctcattttctgctcaagctctttggctttgtcttcatcaacggtcgcctgagctttttcaatcagcgtcagcacgtcacccattccgagaatccgggatgccatccgttcaggatggaacgcttcaagagcatcgagcttttctcccattccggcgaatttaatcggcgtttcggtgaccgcgcggatagaaagcgccgcacctccgcgggtatccccgtcaagctttgttaaaatgacgcccgttaaaccgagctggtcattaaagcttttggcgacgtttaccgcatcctgaccggtcattgagtcgacgacaaggaaaatttcctcaggatttgcgacttcctttacgccggagagctcatccatcagttcatgatcgatgtgcagccgtccggcggtatctaaaatcacataatcatgatgctcttccttcgctttttcaatcgcctgtctggcaatttccaccgggctgacctgatcgccaagcgaaaagaccggcatatcaagctgtttccccagtgtttccagctgtttaatcgcggcggggcggtaaatatccgcagccacgagcagcggtttgcggttatgttttttgcgcagcaggttggcaagcttccccgtggttgtcgttttaccggcaccttggagcccgaccatcataataacggtcggcgggcgtttggcggcggcaattttgctttcttcgccgcccatcagctcggtaagctcttcttttacgactttaataacctgctgaccgggtgtcagactctgcatgacgtcctgcccgacagcccgttcacttacttttttcacaaaatcctttacgactttaaagttaacgtcagcctcaagaagcgcaagacggacttcacgcatcatctcttttacgtcttgttcgctgacttttccttttccgcggatttttgaaatcgtcttttgcagtcggtcggctaatccttcaaatgccattgtttgccgcctcctaatctaatttctcaagcgcttcaatcagagccgtcattttttcctcttcctgcaagccggaagcaagctctttcagctttgtaaacatttctttacgctcctgaaactttttaaaaaggagcagtttttcttcatattgttcaagcatcgcttcagtccgtttgatgttatcgtaaacggcttgccttgaaacgtcatactcttcggctatttcaccaagggagaaatcgtccagataataaagcgacatatagctcttttgttttgacgtcagcaacgactgatagaagtcaaacaaatagttcattctcgtcgttttttcgagcgacatttgagctctcccctttgttaagtcaaatccctttacaaaaacttagtttacatggtttcagagcgtgtgtcaagtttttatcttgtcaaagcaggatgctctttttacataataagtgttttcaaaaaaattcatacagaccgtcgttaaaatactcgaattcttgttttgatacacgatagcggcaatagccttcgtaaaaagcattgagacatgattcatttgtgacaaaacgactgatcgctaatgattcatcataacgcggatctcccgccgatattcccgcagcatcgataaacagatagacctctccgtctctcaccagcacattatcagtcgtgcagtcaccgtgaatcattgtctgctgaacaggaacaggcctgtacctgtccaattccttcaaaagctctgcacttccttcagcttgtccttttttgacatattccccggctcgtttgatttgcagatcgagccagtctgtttccggctgtaaaccagagaccatttcggtttcatgcagccgctgcagaaactggccgaaacttttgatcagctttttcttttcagtatcccctttggcttttcttaaagccgaagtcagggtgattccatcctcaaatgacatgatgatatggctggcatgctgttcctgtatcatcccatagtaaataggaacaggcagacgacgagtttccgtcagttgttgtaaaacgaaggcttctctcattaaccattcccgatacttctgttgaaaagaacttttcagcaaaaatgcgtcttgaccggtcactatttttcgaacggttgaagtgcctccctgttcatccagcagcgacatatggtttatcgcgccgatcttactttccaattcagctttcagccatttgtccaacaactgccccctccattccgatctatcaatgcgtataaaaaaacgagtataaaaccgtccattttatactcgttttttattcattaatcttcggctttttcaactaaatccgaaaagagaccgtatacgtaagattctgcatcaaaccgctggagatcgtcaaccttttctccgaggccgaccagtttcacagggatgtgaagctcattgcggatcgccaggacgataccgccttttgcggtgccgtcaagcttcgttaatgcgatacccgtcacattcgtcgctttggagaattctttcgcctgcgccatcgcattctggcctgtcgtcgcgtccagcgcaaggagaacctcatgcggggcctcaggcacttcgcgttcaatgacgcgtttgaccttttcaagctctttcattaagttaactttattctgaaggcggccggccgtatcacaaatcagcacatccgctcctcttgctttagccgcgtgtacggcatcataaataaccgccgcagggtcgcttccggcagcctgcttaatgacaggcacgcctgtacgctccccccacacttcaagctgttcaatcgccccggctctgaaagtgtctccggcagcgagcacaacggatttgccttcattcttcagcttatgggcaagttttccgatcgttgtcgtttttccgacgccgtttaccccgacaagcagaataacgttcaggcgcccgtcctgaatatttaattcagaaatctgttcgtcgccgctgttataaatgtcgacaagcttttcagaaatgacggactgcacttcctgaggatcctgaatgtttttcagcttcacttcttttttgagctcatcaatcagctccatgacggttgtaaaacctacgtcagcgccaatcagcacttcctcaagctcctcgaagaaatcctcgtcgactttccggtagcgggagacgagttcgttcactttatttgagaaggaatttcttgttttttcaagaccatctttaaatttttcagagacggagtctgtctgtttcgtgattttctcttttaattttttaaaaaagctcatctttcaacctctttcctcgttactgaataaattcttttgtttcttccagtttgaccgaaaccattcgggaaacgccggattcctgcatcgtaacaccgtagaggacatccgcttcttccatggtgccttttctgtgggtgatgacgataaactggctgtcgccgctgtatttttttaaatattgcgcaaacctgaatacattggcttcatcaagcgcagcttccacttcatcaaggacgcagaacggcacgggccttactttcagaatagagaataaaagggcaatggcagtcagcgcccgttctccccctgacaaaagatttaagttttgcagttttttgcccggaggctgcgcgataatgtccaccccggaattaagaagatcattcggatcagtcagcttcagttcagcccgtcctcctccgaataaagaacggaacacgtcgttgaattgagaacggatctggataaacgtttcatggaatcgcttcgtcatttcagaatccatttcttcaatgacttgaaacagtgtgtttttcgcttccgtcaggtcatttttctgctctgttaaaaactgataccgttcgtttactctttcaaactcatcgatgctgccgagattgaccgttccgagctcttcaattgaaagcttgatcagtttgacccgttttctcgcctcttcaggctcgagttcaagctgatattgttcttttgccccttcaaaggataagctgtactcctcgcgtaaatactgcaagagattatcaagctcaacttccatccggccgagttttacctcttcatctttcagaatgtccgttttttgcttgtacagacgcttcatctctttcagctcaagctcgttcgtatcaagagcccgctggagcttcacacgctggtcgcgccggctggcgatcaattcgatcgttctcgttttatcgtgaagcttatgatgggctgcttcttcaagctgctcctcaccgcttgtgctggacgtcatctctgaggtcaggaggcttaaatcttcccgtgtttctttcagagcgagctgcgtttcttcaagctcttttttcagccttttgaggttgtcttcctcactcgagcacgcctgttcttttttcgcagcggccactttacattccgtcagttcatgagagagcgtttcttttgttgaggatagggtctgcttttgttttgtcagcctttccatctcttcctcaagctctttcagctggccggatgcctcactcagctgttcttccagagctgatttgcgcgtctctttttcccggctgctttccgtcagtgatgctttctcctggtcgtaaagctccagatgggtattgatgttcttttcagcaacttcgagttcatacagcctgccttttacatcctgctgctttgttctgaaagcctcaccgtcttcacggagaccgctcagcgtatgttcaagctcttgaatggcctgcttcagcgctttgacctctttttcgagcagagctgttttttcttccatttcggcaagccgcgcagtcaccgtctcaagctcgcggcttctgccgagcagagaattgtttttctttttgaccgcgccgcctgtcattgatccgcctggattgacgacatcgccctcaagcgtgacgatgcggtagcggtgcccgagaagcttggccagttcattcgcgccttttaaatcttcagtgatcagcacggtgccgagaaggttttgaatgacattccgatacgccgcatcatatgtgacaagcccgctcgctgtgccgaggaaagacggatgctttgaagccgtctgttcatcacgggtttgaagctggcgcggtttcataactgtaagcggcaggaacgtcgcgcggccgaaggaattctgttttaaatattgaatcgctttccgcgccgcctgctcatcgtctgtgacaacgtgctgcgccgctgcgccgagtgcaatctcaatcgccgtttcatatttttgttcggtcgcaatcagttcgagaacggcgccgcggatgccgccgagctgctctttctgcttcagcacttcttttacgccttggtaaaatcctgaaaaatcgccttgcatcgtttcaagcatatcttttttggatctggcctgctggacgaattgatatgcctgatacagcgctgattctttcttttcatactggcgttttttctgttcatatgctgtctggacttcgcgaaagcggacgacctgattgtgaatatcctcttcaacggcggccaattcctcttcgcacgccgctttgcggactgcaatatcgttacgttcttcaaggtatttttcattgtttgcggtcagtctcgcctgctggaccgcagattgggacatctgatcatctaaaagctgcagctcgttgcgaatcgacgcctggctgtttaacaattcaaagtaatcgctttttaattgttcgattttctcttctacattttcattatgcagactgagagcctgctgcttttctttcacctgggcgtttaaccgcttcacttccgcacgaagtttatcatagacggcagactgtttttcaatgtccgctttcagttcggcttctttgttcgtgtaatgtgtaacggattcctctagctgttcccggttttgcgcggcgttttttttgcgctctttcagcacttctttccggccttccagcttttccagctcttcacttgtcacgagcagcacctgctgcagttcgttgacggattcatcaagcgcgtggattttatctctcgtctcttctatcatcgcttcttttgcggacagagctgatgattccgccaattcttcttgttttgccgtctgcaccttttcttttaaacccgaccatctgctatgcagttgttcgatgtcaaaggcggtaagggcgatttcgacatgctcaagctctttctttttttctaagtagtctttggcgattgatgcctggattttcagcggttcgacctgatcttcaagctcgtggagaatatcttccaccctgtttaagttatcctgcgtctcaaacagtttgttttccgcttttttctttcgtgttttatatttcagcacgccggccgcttcttcaaaaatactgcggcggtcttccgctttgctgctgagaatctcttcgactttcccctggctgataatggagaacgcttcttttccgagcccggagtccataaataagtcaatgatgtctttcaggcggcactgctgattgttgatgagaaattcactttctccggaacggtacacccgcctcgtcacgctgacttcgtgataatcgatcgggagaaaatgatcttcattatcaagcgttaacgtgacttcggcaaggttcagccgcttgcgcgaatcacttcccgcaaaaatgatatcttccatttttccgccccgaagcgagcgggctgattgttcgccgagcacccagcggatggcttcggtaatgttgctctttccgctgccgttcggaccgacaacggccgtgacgccttttacaaagtcaacggatatccgttctgcaaatgatttaaatcctataacgtctaaacgtttgaggaacatcccagatcctccttatcgtataagtatctcaatattatcataatcacccgcttatatcaggcgcagacatactgaaatccccctagggatacagggggattttattgtttcgtatgatgtttttgcaattttgcaagagcttcctgtgccgcatgctgctcggcttcttttttggaacgtccgttcccgataccgagcgcctcacctttaagagagacgagcgcctcgaattcccggttgtgggcaggccctttttcattgagaattttgtactcaagcgatccttttccgtcccgctgtacaaattcttgaagctggcttttgaaatccatcacatgagaaaaagcaccatcgtttattttagggaacacgtactctttcaggaattgctgaaccggctcaaggccctgatccagatacagtgcgccgataaacgcttcaaacacatccgctaaaagcgcaggacgctttctgccgcccgtcatttcttctccttttcccaagagaacaagatcgccgaatgacaattcgtgggcaagtgagacgagtgacggctcgcatacgatagcggctctcagcttcgtcaaatctccttcactcatggccggatatttggcaaataagaattgggagatcgtcagttccaaaacagcgtcacctaaaaattcaagcctttcgttgtcttcatacggctttttccgatgctcattcacataagatgaatgtgtaaatgcttgatacaaaagtttctcgttttgaaaatgaaccgaaatccgttcttggaactctttaaattgctctatttttttatagaacttttttttatctttaaaatgtgagtgttttgacatagtaacctccataggcacatcaggttcaccgcgctccccgccgtaaacggaatcagcagcgcgtacagcgtcagacgccggtaaccgaacgattaaagggctaaagccccgctgtcaggcgggacttttagcatcagcttattgctggttttgtatgtagttcacagcgtcgccgactgttgcaatcttttcagcatcttcgtcagaaatctccatatcaaactcgtcttcaagttccataacaagctcaactacatctagggaatcagcacctaagtcttccttgaaagaagcttcaagtttgacgtcagcttcatcaacgccaaggcggtctacgatgattttcgttacacgctctaatgtatctgccatagcaattcacctcccctcaagtattatagaggattcgtttttaaaaaactagagaaactaggatgaaattttaaaaacaaatctttacatcaccattccgccgtcaatatgaagggtttggcccgtcatataacgcgatccttcagaagcaaggaacgtaacaacgctgctgatatcggaaggatcaccgaaacgcgcgagcggaatctgcttcagcatttcatcttggacttctttagaaagcttgtccgtcatatccgtggaaataaagcccggagcaatggcattgaccgtaatatttcggctcgcaagctctttggctgatgacttcgttaagccgattacaccggcttttgccgccacatagtttgcctggccggggtttccgctgacgccgacgattgatgatacgttgataatccggccggagcgctgtttcatcatctgtcttgtaacggctttcgtgcagttgaatacaccttttaagttaatgttaatgacatcatcccattcattttctttcattctcatcagaagattgtcttttgtgatccccgcattgttcacgagaatgtcgattgaagaaaatgcagcgacagcctctttcatcatgttttgtacttcttcggaatttgatacatcggcttttacggcgatcgcgtttcggcccaaagatttgatctcatctacgacttcgttcgctttcgcttcattcccggagtagttgactactacattacagccgtttttcgcaagatcaagcgcgatcgcccgaccgattccgcgggacgctcccgttaccactgctgttttttcattaagcatcctgattctcctccttcagcgtttgaatcgccagttcgatggtttcatggtcagaaaccgagattgttttaaggcggcggttcacttttttcacaaggcctgaaagcacttttccgggcccgatttcaacaaacgtcgtgacgccttcgtcaatcagtttgttaatggtttcttcaaagcgaacaggcgaatacagctgttcgatcagttttttcttgatatcgtctttttccgtcataacgtcagccgaaacgtttgaaatcacgggaacagccgcattttttaactcacaggcgctgagcacctcctcgagtttttgcgctgccggcttcattaattcagaatggaacggtccgcttacttctaatgggatcgcccgttttgctccgttgtttttcgcttcctctgaagccagctccacgccttttgccgttccggaaatgacgatctggccggggcagttcagatttgcaagctgtacgagatgaccgttttccgtcacttgatccgtcacctttttcaaggactccgcatccattccgagaatcgctgccatggcgccttctccggccggcacggcttcattcatgaattctccccgttttcttaccgtgtaaacggcatctttaaatgtcatcgctcccgccgcaacaagcgccgaatattctccgaggctgtggccggcggtgaaatcaggggtgatgccggattctttaaacttttccaatacggcgatgctcgttgtcaacagcgcaggctgcgcattgtatgtaagggtcaattcttcggcgtcaccttcaaaaatgagcgagctcagctttgtttcaagcgtttcatccgcttcatcaaaaatacgttttgacgcttcttcgcgttcgtacaggtcttttcccatgccgatatattgtgatccctgtccgggaaataaaaatgcaatcttactcatgatgcggtaacctccagactactcatctgttttttcttcttttacttcttcttctataaatgcggccacgttttggctgaccatttctctcgcctggcgcagcgcatggtaaacagcgcgtgcgtcagaagagccgtgcgctttaatgacgggcgctttcaaaccgaaaagactcgccccgccgtactcagaatagtccattttcagtttcatttccatcagcttcggctttagcacgcccgctgcaagcttagaaacaaaacttgaagtcagtgtatctttcagcattttgaaaatcgataacgctgaaccttccaatgttttcaacgtgacgttgcccgtaaagccgtctgtgacgatgacgtcagcagcgccttcgagcaagtctctcgcctcaacgtttccgacaaaattcacgtttgtttcttttaataattcaaacgtcttttttgtcaggtcgtttcctttcttttcttccgtgccgacatttaacaatccgacgcggggcgagctgattccgagaacctgccgggcataaacagatcccataattccgtactggacgagatgctccggtttggcatcgacattggctcccacgtccaaaagaaggaaaccgtcgcctgaaacggtcggaagcgtcggcgcaagcgcaggccggtcgattcctttaattctgccgacgataaacagtcccgctgtcatgagtgcgcccgtattccccgctgagatgcaggcgtccgctctgttttcagccacttcctgcgccatcagcaccatagaagagtttttctttctgcgtacggcgcggaccggttcatccgtcggttcaatcacttcatcggcgtgcaacacagtgatgcggtctgatgttgttggcaagtgtgattctatcgttgtcttgtcaccgaccagcgtaatatgaagatcgtcaaatgcctcaatactcttcattactccgtcaataacagctttgggtgcgttgtcgcctcccattgcatctacagctattctcatgcatgctccacctttatgattgttttgaacggtacatgtcaaagctgccggagaacacgacttcttctcccacatagctgttgacttcaactaccgttctgcctttttctttttcgactgccgtcactttggctttcgcaacgacgcgctcgccttctttcacctgtcttgtaaagcggatatttgcgcttgcggtcagcgccagctcatcatcaatgacggctacggcgagtgagttcgcctgcgcaaacaaatgatgcccccgcgcaatttgattgcggctgaagacatgttcgcgtcttacttctaatatggaaatggcctggccgtcaagctccagatcaatgatttcaccgatcacttcgtctaaagacaatgatttcacttcatcatcaagcgtttgttctgccacgtttttaattctttccctcagctccggtattgagagctctaagcggtctaaacggatcgtctgaatgctgacgccgaatttccccgctaattcttcatctgtgatgaagggtgtcgatttgatcgtctgctgcaataatttttggcgttctttcttgcttcttctcatctgtaaacaccatccggacaattaagactaggtactaatagtagtatataatctcatagattggaatgcaatgattgttttttgaaagccgccgaattttacagaatcagcttaatttctccccttctaggacgccgcttgaaagtaattgaccgcgcagcatgcggtattcgtcatctttccaaaaagcctctgaagacaccagattggccgcatcctggcgggccgtttccaaagctctgtagtcatgaaccatatccgccaccttgaactcgggcataccgctctgtttttttccgaagaaatcaccggggccgcgcagttcaaggtccttttcagacagctcgaagccgtcgtttgtctctgacatgattctcatccgttccttcccggtttcggatttcggatcggccatcaagatgcagaaagattggtggtctccccgcccgacccggccgcggagctgatggagctgagataatccgaaacggtcggcgtcatagatgaccataatcgtcgcattcggcacgttcaccccgacttctacgacggttgttgacacaagtacctgacattgattggcgctgaattctctcatcacttgatctttttcatcagaatggagcttcccgtgcatcaggccgacattccatttaccgcggtaaacgtcagacagcatgttatatacgtcaatcgcattctgtacatccagtttatccgactcttcaatgagcgggcagataatataggcttgccttccctgcttcagctctttttctataaaagccaaaatccgctccagcatgtcgtgtttcacccaatacgtttcgatttgttttcgccccgcgggcatttcatctatcacggaaacatccatttctccgaagacggtaatggccaacgttctcggtatcggggtggctgtcataaacagcacatccggatcttgacctttattcttgagttttttgcgctgttcgaccccgaaccggtgctgctcgtccgtaataacaagactcagcgctttgaattccacttcatcctggattaaagcatgggtccctactaaaatatcaatctctccgagagcaagccgctccaaaagctccctgcgccgctttccttttacagaactcgtcaaaagcgcgatatttacatcttcatttgcaaacaacgatacgagagaatctgcatgctgttcggccagaatttcagtcggcaccattaatgccccctgatgccccgacagaatcgcagcgtacaaagcgatggcggcgacggccgttttccctgaaccgacatcaccttgcagcagacggttcattcggtaaggggatgtcatatcagcggtaatttcccgaagcacgcgcgtctgtgcggtcgtgagcgaaaacggcaggctgtctgtgaaagcggtgagcttttcagcaggaaacacatggctgatgccttttgactgttccctttccgctttacggaacgcctgcattttcagctgaaataataagaattcctcataaacaaaccgtcgtcttgcctgctgtaacgattccctcgtttcaggctgatgcatcgtctgcagggcatgtttgtaatcaggcagcttatagcggattctcaatttttcaggaagcggatcggccgcactgtccaaatgatgctgcagcgcttccttaataaaccgtctcatcatttttacggtgacgttttctttaacggaataaacaggctcaatgcttttatcttcttgatgaggaccgttttttaattcctgcacggaaacggtctgtctgtgtttatcccatttcccggatatcgtgacgacagaacctaacgtcagtttcttttttaagtagggacggttaaagcagaccgcggtaattaaataattgccgacaagcaccctgaatgtcagcctgtttcgttttttgccgtaataggtaagagaaggttctgaatgaaccttcccttctaccgtcactctttcttcatgttttacttcttctaaatccctcagctcatagtcgtcataacggtaagggaaataattcagaagatcagaaatgtcatagataccaagttcgtgcaatgttttttctgtttccggcccaatgcccttaatttccgctatactagtttgctgatggtgtgtcacttgatttcagcgctcctccgaaaatttttttctctaattctcttcccgtcggtgtcgcagctaaaccgccttgtcccgtttcacgcagtgctgtcggcattgtctggccgattttgtacatcgcgtcaatcacctcatcgcaaggaatgcggcttgtaatcccggccagcgccatatccgccgcgatcatcgcgttggatgctcccattgcgtttcgtttgacacacggcacttctaccaatccggcgaccgggtcacatacgagaccgagcatatttttcagtgtaatcgccattgcttccgctgattgctgaggcgttccgcccgccatttccacaatcgcggccgctgccatgcctgatgctgacccgacttccgcctgacagcctcctgccgctcctgaaatactcgcattatttgctacgacaaaaccgaacgcgccggctgtaaacagaaaacggatcatttgttctgtcgtagggttcagcttatgctttacggcgaataacgttcccggcacaaccccggcagagccggcggtcggtgtagcgcagatcgttcccatcgccgcattgacttcatttgtcgccacagctttagaaacggcgtctaaaatcagattgcccgaaaggcttcttcccgattggatgtatgcctgaagtttcacggcatctccgcctgttaaaccggtctgactcgtgacgcccttcagccctttttcaacagctgcttccatgacggagagattgcgctccattccttgaaagatttcttctcgtgttttttgcgtcacttccatctcttgggtgatcatcacttccgaaatcggaatttgtttttcttgagtgatttctattaattcttttacattacgaaacatgtcattttcctcctgactttttagtcagctatcttagtaacctgtataatattaggaagtgttgaaagctcgtcaagcacttcttcttcaatattctgatcgacctcaatcgtcatcagcgcaagctggccgacgtccttacgcgccacttccatatgtccgacgttgatggagaatttcgcaagcacattggcaacgcctgcaatcgtgccgaatttatcattgtgaacgactaaaatagccgggtggtttccggaaagtcgcagctcaaagccgttaagctccgtgatttctatttttccgccgccgatggaaataccggtaagggcaagctctccctcatcatcagaaatgacgatacgcgccgtattcggatgaacgggcacggcatcctctgtacggaactctacatatatgcccttctcttccgcaatttgaatcgctgttttaatccgttcatcaaatgtatcaaaatcaagcaggccgccgataatcgcgacatcagtgccgtgacccttatacgtttctgcaaatgatccgtaaaaagacacaacgatccggcggggctcacgcctgaataagcttctggccactctgccgatccgggcggcgcctgcggtatgtgaactggacggaccgatcatgaccgggccgataatatcaaaaacgcttctatacttcatgctggtttgctcctccttaacatcacttcattcagcgcttttctttagactaattgaacatttctcaattggcaagcaggcacactgccgcactgccgcaggtaaataaaggcataagaatagaagggcctgataagcccttctattctgccgcaaatatatatggatacagaggctgtctgccgttatggatttcaacctcgatatcttcacagacgctagcaatatactcagcgagtttctcagcttcttcttccggcgcgtcctctccgtacaggatggtgacgatttcatcttcttccccgatcatttcatccagcagcaatttcgccgcacttatccgatcttcggcgctgccgataattgaactgtttaaaatgccgataaaatcaccttttttaatttctttgccgtcaatatgggtgtctctgactgaatatgtcacctgtccgcttttcacattccggatggcctcaagcatattggcttcatttacatcagccggctggtcagggttaaacgcaagcagggcggtcatgccttgagggaccgtttttgccggaatgacaatgacattttcttcagctacgctcgccgcctgattggcagccatcacaatattggaattgttcggaagaatgaaaaccgtctccgcattgacagactgaacggcttcaacaatatcttccgtgctcggattcattgtctggccgccttcgattacgtgtgaagcgccgatgctcgtaaacaattcagaaatgccctctcccattgccacagtcacgatgccaaaaggcttgcgggcttctttcataacgccggccggctttttttcatcatgttcttggctgatgattgaagtatgctgttccctcatgttttcaattttaattttaatcagatcgccgtaacgctgtgcgagattgagtacgttcccaggttcttcggcatgaatatgaactttcgccagcgtatcatcagccacgaccagcaatgaatcgccgaaacggctcagttcgtttctgaacgcctcttccttgaacgtccgtttatcttgatccagcctcaccattacttccgtacaaaatccgaattcaatgtcttctgtactcagcatgctctgcgcgcttttatgatgctcggcattcaccatatcatcgagtgccggaagaaccgcttttttcggtacggcctctccttttaaagcagccaaaaagccttcatatacacaaagcagaccttttccgccgctgtcaacgacaccgacgtcctttaaaacaggaagcagatccggcgtgcggttgagcgacgcttccgcttcttcaataacggcctccatgactgaaataatatcggtttcttctttggccgaggcgaccgcttttttagccgcatccttggccacggttaaaatcgttccttcaaccggtttcataaccgccttatatgccatatccactcccgcttggagtgctgcggcaaactcttgggcatcaatttggtttttgttttcaatgctctttgtgaaacctctgaacaattgggacaagatcacccctgagtttcctctcgctcccataagcaggccttttgacagggcgatgccgactttgccgatgtcgggtgagtcaatgtgctctacctctcttgcaccggatgacatcgataaattcatatttgttccggtatcgccgtcaggcacgggaaacacgttcagcgcatccaccgcggatgcgttttgagacaatgtctcagcccccgccagaatcattgccgcaaaagctctcccatctaagtttcgtctagacaatactcatcctcctcactacgggttcgttactcgtacgccttggacataaatatttacagaatcaactgcaagtccgattgtttgatttactgtgtattttaccttcgtctgaacattgtgggctacttcggatattttagtgccgtagctgacaataatgtacatgtcgatatgtatttgttcggcttcctgacggacatgtacgccttttgcgaagttctctctccggaggatttcagacaaaccgtctttaatctggttttttgaggccatccccactattccgtaacagtcaatggcagcgcctccggcaaccattgcgatgacttcgttggatatatcaatctgtccgtattttgtcttcatttcaatggacacacaggttcctccttcaggtgcatagagttatcattattctactatatgtatcccattatgaaaagaaaagatacagacagcggccttcagcgcggaaatgtgattggttttacatgtcaagtgatttttcttgaaagtaagggaaacaatagttgcaaacggtttttagctgtggtaaattatttaaagtattgtataacgaaagcatctgagacactatgtttaaaaagatgtttcgcgcagttaggagggaaacaaatggcacgtaaatgttttattacaggtaaaaaaacaaaagccggaaacaaccgttctcacgcaatgaacgcttctaagcgtacttggggcgccaaccttcaaaaggtccgcatcctcgttgacggcaaacctaaaaaagtgtatgtatctgcccgggctttaaaatccggtaaagttgagcgtgtataagcaaaaatgaacgcctgcccttttatgcggcaggcgttttttatgcgttcaaagagggcgatttcagcttcttgggcttactcttttctaaatgagcccagcatcgcccggacaattcctcctaaaaacttcggcaatttaatggtataaaatttcattttgtcccctcctataagtcccgtatccgctgcgttcatcactttaggattcatggttttttccgcatatggcagaagccgcttttctaatccgcgctccttaccattattaatatgccttttgcaaacgaaaaagtacctcgtgaatgaatgagttcgttactaatacatagtgtggaacccagaggaatatgacaattatcaaggggatatttaaaaccgtcgagtgtcaggccgtctgccgcttccgtaaacggaatgaaagaaatatagcgtctgcgcgctttttcttcaattgtataacggccgggcccgaacatctgaatgtcattctgccggtcgatcagcttgacatcggtatgcttatgtaaggctttatacagcagctggatgttccctaaaaagtgatcggctcttccgcccgtcacaccgaatacccgaatgttttccggttctttttgtaaagcccagtcaagggcgagttcaagatcggtataatctttttccgcctgatacacatggagggccggcgccgctttttgaatctgcatgagctcctcttccgtaatgctgtcaaaatcaccgaaagcttcctgcggaatgattccggcctccaaaagagcaaccgtccctttatcaactccgacccacgtcgtatctccgtctgtgtattcggatagatcgggaataagctcccgcgggccgcccgcaacgatattgattgtcttcatatgctatcctctctcttagacgcgaaaagagccggcggctttcaccgggctctttttcagcatgtttatgatgcgtttcggatgtcagcgatggcttttttccgatccggctgattatatacggcagacccggcaacaagcagattggcgcccgcttcagcgcataaaggggctgtttctttattaacgcctccgtccacctcgattaaaagctcagacaggcctttctcctcagccagctgtttgacctgacggattttcggcagaaccgaatgaatgaagcgctgtccgccaaaaccggggttaaccgtcattaacagcacaaggtcaagctcctcgatcacatgttcaatcatttggacgggcgtatgcggattaagcacaactcccgcttttaccccctgctcttttatcaattgaatggtccggtgaagatgcggacacgcttcagcgtgaacggaaaggatgtccgcaccggcttttgcgaatgccgggatgtagcggtccgggttttcaatcataagatggacatccagcggcagatcagtcaccggacggacggcttcaacgataagcggcccgattgtaatgttagggacgaaatggccatccatgacatcaatatggatatagtccgcccctcctttttccacgtctttaatttcctcgcccagtgaagcaaaatcggcggaaagaattgatggcgcaaccttaatcatattaatacctcggctttctctcttttatttcctgcataaattctttgtaatgctcgtagcggtacggctgaatctctccttcttccaccgcttgctttaccgcgcatttcggctccttaagatgcagacagcctctgaatttgcaggaggcgcttatttctctgatctcagggaacgtgctgcccagctcttcttcctcaatgccggtaaattcaagcgaactgaaccccggagtatccgcaaccagaccgcctgatgtatgaatgagctccacatggcgcgtcgtatgttttccgcgtcccaaatgcgcggaaatctcgtttgttttcagctcaagctccgggctgatcgcatttaaaagcgaagattttccgactccggactgaccggcaaacaccgtcgttttgtcctcgaagtgtttcacaatgcctgttaagccgctgttttcttttgatgacgtcacatatacgtcataaccgatcgcctgatagtctttcacgtaagaaagtatcgcctctttcgattccccgtctgcagctaagtccattttggttatgcagatgatcgggtgaatgccgttggcttccacaaggacgagaaaacggtccaataaagacgtgctgaacgccggctgaacggcagaaaagacgagaacggcctgatcgacatttgaaatcggcggcctgatgagctcatttgttcgttctttgatttccagcaggtagccttctttatcattttcagcctgataaacggcataatcgccgaccaggggcgttattttattttttctgaaaatgccccggcctctgcattgaatgatcttgtcctgtgattcatccaagacataatagaatccgcttaacgcttttataattttgccctcaggcatagggtccctccttatcagtcattatctttcgggtattcaatcgttttgtagctgacgactttatgatcgaccatcacttgataataccccttctgtccctgatcaatcttcagttcaattgttttttcggtcggctcttttattttaaatgagtcatacgtatcagagatgctgtggtccttatcatcgatggcgatttgcacttcaagctcttccccttcatgttcgggttcgtaaggaatgctgattttttcttttaccgttttcgccggtttttcttcaggtccgagcgagaacgtcacttcaacattacttcccggcttaaccgcagtgccggctgacggctcttgtttcatgacttgtccttccggcacgtcatctgaatgggcttgtttttcaacaagctgcaggccgttatcttcaagataccctgaagccgcttctttgctgtaagtctttaagtccctcagcgtaacgtccgccgggccgaggctgaccgttagattgacttcatcatcgcttgcgaccatatcggtgccggctgacgggtcctgatcaattacggtgccggcctcgctgtcatcgttttcttctttgacattgacatgtttgaaacctttttccttcagcgctttttttgcgtcgccgatctgccgtcctttcacgtcgatcagctgggttttcggttttccgatgcttttgtacagttttacagaagagccttctttaacggtagaccccgcttttgggtccgttttgaccattaattcctcttctattttttcatcttcaatatccgttatatcaggatcagcccggagcccgttcttttcaagcagggcttccgctttttcgtacttcatgccccgtacgtcggggacgcttacatctttaggcataaataaagacgggaacacggtgaccgcaagaacagccgccataataaaaatgaaacagacggccagcaaaacccacggccatttccgttttttctttttggctggctgctgttccttatcatccgtctcccccggcgtttccgcctgagacgcggcttttgggccgtcagtaataacgggaatggcttttgtcatttcctcatcatcctgcacggaaaatttttgttcattcagcctgccggcgtcaaaagccgttctgatgtccgcctccatgtcctcggcgctttcatagcggtgaaacgggtctttggcggttgcctttaaaataatgttttcaacgctctgcggaatggaagggttccactttctggcggaaggcgtttctgtttgcaggtgctttagcgctatgctgacggctgattctccgtcaaaagggattttgcctgttaaaagctcaaacagcacgatgccgagcgcgtaaatatctgattttttcgttgccagaccgcctctcgcctgctccggagacaaataatgaaccgagcccagcacagaattcgtatgtgtgattgtcgtagacgtaagcgctgtggcgatgccgaaatccgtcaccttgatatgccctaaatgatctatcaatatattgtgcggtttaatatcccggtgcacgatatggttttgatgggcatgggcgatggccgagacgatctgctccataacggacagcgcttctttcggatgaagcggtccgtgtgcgtttatgtattcctttaatgtcatgccttccacatattccatgacaatgtaataaatatcgccttcctccccgatatcgtaaatactgacgatattcggatgatcgaggcttgatgccgactgtgcttctcttctgaaacgcctgataaaatcaatgtcattcacaaagtcaaaccgcagaattttaattgcgacttcacgttcgagaatgatgtcctcagctaaaaaaacgtttgccattccgccgccgccaatgggccggaggatatgataacgcccgctgatccgcttgccggttagcacttgtcttcaccctcttttgcatctgcggaaaactcaatcaacacagccgtgatgttatcttcgccgccgttttgatttgctttgctgatgagaaggtctactttttcctgatgatcagattcggcttgaagcatttgtttgatctcgtgatcttctattttatttgacagtccgtcagagcataaaagcagctgatcgccgtcagacagttcaaaagaacgggcgtcggggctgatggtttcatctgtccccagcgctctcgtcaatacatttttccgcggatggtgctcggcgtcctctttcgaaatctcccccgtcttgaccagctcattcacaagcgaatggtcctcagtcagctgagtgaattccccctcttgaagcaggtagcaccggctgtcaccaatatgagccacagtgacaaacttccccgtgaataaggcgcagacaatggtggtgcccattccccggcattcttcattggctttagcgtggtcatgcactttgacattcgcctcatgaatccggtctttcagccaatcctcgcaagcggacggcagagaaggaaccgtttcggtccggttccactgctcttccatcgccgcaaccgccatcctgctcgctacatctccggcaagatgaccgcccatgccgtcggcgacaaccgcaagcaccgcgtcttcttttgtgaaaatgcccgccgcatcttcattatgccggcggactttacctgtatctgttttcaaggctgtaatcaacctcttcacctcgtctcgtcttgacgctccttcgcgcgaagctgaccgcaggccgcgtcaatgtcatggccttgctctcttctgatcgtgacatttacaccgcgggattttaacgttttttcgaatgcgaaaatctgatctctcggtgtgcggacgtaatcccgttcaggcacatagtttaccggaattaaattgacatggcatttcacgtcttttaacagttctgcaagctcttctgcatgttcgacctgatcatttacgccgccgaacagcccgtattcaaagctgatccgtctgcctgttttctcgatgtaatatttgacggcctccataaggtcaggaagcttataggctttgttaatcggcatcagacggcttctgatttccgtattcggagcatgcagagaaatcgcgaaattgatctgcattttttgatcggcgaaatcgtaaatcttcggaatgattccgctggtggaaactgtgatatgacgcgctccgatgttcagccctttatcgtggttaatgatttttaagaaagcgagcatttcattgaaattatcaaacggctctccgattcccatgatgacgactgagctgacgcgttcatccgtttcatcaagcgccttttgcactttcacgacttgagcgacgatttctcccgcttcaagattccgtttcagaccgccgagcgttgacgcgcaaaatgtgcagccgatccggcagccgacctgtgtcgttacacatacagaattaccatactcgtgtctcattaaaaccgtttcaatcgtataaccgtcatgaagctcaaataaaaatttcatcgtgccgtcttgagatgtctgttttacagccgttttcagcgttgtcagcacaaaattgctctcgagtttttcacgcaggctttttgagaggttcgtcatttcatcaaatgaagaaacccgcttttcatagagccattcaaaaatctgtgctgcgcggaacggcttttcgccattctcggtcagccattgtttgatttcatctaattcaaaagagtaaatggacggctgctcagtccgcagctctttccgtacgcttgtcttttttaattgtgtcatttttatcccttctttctcatgctgctaataaagaaaccgtctgttccgaaataatgcggaagaatttgaaggcttccatcctgaacaaagggtctcgccttttcaggcagccgcttttcaagagacaaatcgggttcaaactcagggtgttcttgtataaacgcatgcataacttcttcattttctgtccgatccattgtacacgtactgtatacgagtgtgccacctttttttactaatggggcgatttcccttaaaatgccgagctggatttctgacagccgtctgctgtcctccggcgtcttcgtatatttcatatcgggttttcttctgatgacgccgaaacctgagcaaggggcatcaacgagaatacggtcaaaccgttctgcgccaaaggcctctcccgcttttcgcgcatccatcgtttgcgcgtcgatgatcgtaagaccgagccgttctgcgccctctttaatcagcttcactttatgacggtgaagatcaagcgatgtgaggctcccctcgttctccatcagttccgcaatgtgagccgactttccgcccggtgcggcgcatgcatctaaaacggtttcgcccggcttcgggtccagcgcccgggcgacaagcattgagctttcatcctgtatggatacccggccgttttggaaaaatgccgtgttcgcgatgcttcctttcaaaagcttaatcgcatcaggagaaaggtctccggcttccgcttccagaccggcattctccatctcattcagcaccgtttccctgtcgctctttatgtgattgacacggagcgtctgcttcggcggaatgagatgaatccggcagattttttcagccgcctcaaagccgtacgcctcgacccactcttttacgagccattcgggatggcttgtctctgtagaaagacggagaaccgggtcttcaatttcagcaaatgacggcgccccctcacgctgcagggagcggagaatgccgttgacaaaggacgcaatgcccttatgcccgcgttttttggcgatttcaaccgcttcatggatggcggcgcgatccggaattttttctaaatactccatttgatacgcggacagacgaagcagctgaatcacccacggcttcaccttattcggcttgcggataaaaggcttcagcatatagtctaaggcgattttattttgcagcgttccgtagacaagctctgtcagcagtcctctgtcctgatcgctgagcgtgttcgttttgataaccgatgtaagaagcaggttgctgtatgcctgattttgctcaagcttctcaagcgcttcaagggcgagctcccggacattaattttcttcatttgctgctcctaacacgtcaccgggctgcacatttttgcctcttacaaaatcttcgcccttcatccgttttttccccgccggctgcagctcagtgattaaaagggcggtgctgtttcctgatgcgacgacaatgccgttttgctccgtgcggatgactgttccgggcgcagcatcagtttttgccgcaactttttcagaagcccatactttaatagtttgaccgttcaaagttgtataggcgacaggccaagggtttaaacctctgatctggttgtagatctcttctccgggctttgcccaatcaatccgctcctgctcacgcttaatgttaggcgcgtaagtcgcttttgattcgtcctgtttgatcggtttaatatttccggagatgacgttcgggacggtctctgacaaaagctttgcccccgctatgcttaatttgtcgtgcagcgtgccgacgttatccgtttcatgaatttccacttcgattttagaaatcatatcgcccgcatcaagcttttcaaccatatacatgatcgtcacgcctgttttcttcttgccttggagaatcgaataatgtatcggcgctccgcctcttaattcaggcaatagtgacgcgtgtacgttgatacagccgtatttcggaccgtccagcagctgcttgggcaggatctgtccgaatgccgccgtaacaatcaggtccggcttcaggcttagcactttttctatttcttcttcgagccttactttttcgggctgaagcacgggaatgccgtgacgttcagcttcagcctttacaggagggggcgtcatgattttttttctgcctttcgggcggtcaggctgcgtaacgacaccaaccacttcatatccgtcttcaataagcgtgcgcaggacgggaactgaaaagtcgggcgttcccataaaaacgatccttgtcatccaatcatccttccatttctgccagttcttcttcagtgtagtaagccgtaatttttgatgtgaataaaatgccgtctaaatgatccatttcatgctgaacggctctggccaaaaaaccctccgcttctaaaataaacggttttcctttacggtcgtgggcttttacctttacgtaatccgggcgggtgacatcaccgaaaaccccgggaaaacttaagcagccctcgactccggtctgttcaccgctcttttcaagaataaccggatttacaaggtcgatccggccgctttcttcaccgatgtccacgacggccgctctttttaaaatgccgatttgcggcgcggcgagaccgacgccatccatttcgagcatcgtatcgtacatatcgtcaagcagtttttttaattttttatcaaacactgtcacttcatcggcgggtgtttccagaacctccgccgggtgtgtgacgattttttttacagccaaaattttgccctccaaaaactaatgttacatcagcatgtacggattcatatcaattgaaatcattacatgcttttgcgcaatgtcgcgtttatagtgctccagtatctttttcaactgaatctgcaactcgttttcctgtctgtattttatcacgcattgatagcgatatctatctttgatcctggcaatcggggaagccgccggcccgagaattttcgtatcaggcccgcatcccgctcttaaatagtttgtaatcttttctgcggtgaccgcggcttttgccgcttcttcatgagaaacggtcaccagcgccacgtaataatacggcgggtatgactgggcccgtctgtgcgccatttcctgctgaaaaaaagtttcatagtcgtgcgttttcgtcagctgaatgctgtaatgagacggtgtatacgtttgaatgaccaccgttcccggcttttcatgccgcccggcccgtccgcttacctgtgtcagcagctggaatgtcttctccgcggccctgaaatctgggatgtgaagcgtcgtatcggcgcttaatactccgacaagcgtcacgttcggaaaatcaagcccttttgcgatcatctgcgtaccgagcaggatatccgccttcccttcaccgaacgctgacaacagtttttcatgggcgccttttcttgaagtggtgtccacatccatcctgatcacgcgcgcctgaggcagcactttggtaagctcctcctccacacgctgtgttcccgtgccgaaaaagcggatatgttcgcttccgcattccgggcatgttcccgggacaggttcctcatggccgcagtaatggcatttcagcctttgtccgtagcggtgataagtcatggaaatgtcgcaatgcggacattgcggcacataaccgcagtcccggcacatcacaaacgaggaatacccccgtttattcagaaaaaggacggcctgctctttttttgcaagcttctcttccagctgttccatcagctctcttgagaacattgatctgttgccgtttctcagttcttctctcatatcaacgagagaaacgtcaggcatgagctggcggtttacgcgatgttttaacggaagcagctcataaacgccttttttcgcccgcgcaaatgactccaatgtcggcgtggcgctcccgaggacgaccggacagctgtgatgctcggcccggcggatggctacgtccttcgcatgatatcgcggcatttcctcctgcttataggaagattcgtgctcttcatcaataatgatcatgccgagattttcaaacggggcaaagatggccgatctggctccgacgacaagccggacttccttgcgctgaatcttccgccattcatcgtatttttcacctgtggataatccgctgtgcatgaccgcaacctgtgagccgaagcggcctttaaaacggttgaccatttgcggtgtcaacgaaatttccggaacgagcacgatggcttcttgtccttttgccagcactttttcaatggattgcaggtaaatttccgttttgccgcttcccgtgacgccgtgaagcagaaagacgtgatggacatggtcggctacagcttgtttaatcggctcaaaagcggcctgctgctcttctgtaagagagagcggctctgtttttttgaacattctgtcctgataaggatcgcggtaaacctcctcaaagctttccgtaagaagcccctttttaagaagcgttttcagcgtcgcggaactggaatcggtctttttgcaaagttcagccgcggaaatcttttctcccccgccgataaaataagtaagcacggcgagctgtttagaagcctgctttgtcaatgaatctgcgtgccgggcgagttcttctttgtctgcccccgcttcaatcatgcggatcatttttttattcgttttttgggcgactttatatgtgacatcaatgcttcctttacgcacgaatttctgaagtgacgaaagaatgctttcatcggtaatatccgagtacagaagacttttttgattcctgaaaagctgtttgatgtccggtgtcagcgcttcttcgtcaacgactttcagctctttctcgtacttcgccttcaatgcggcgggcagcattgcctgaagcgccgtgattttaaacgacagcgttttgtcagaaagccatgaagacagctgcatcagttcctcagtcagaacaggcgtcaaatcaagaagcttctcgacttccttcattgagccgccgtttaattcggacgaatctttcaaaccggtcacaaatccttgaagcttgcgcgggccaaacgggacaatcacccgcatgccgacttcgatcatcccttttaaatgatcgggaattttgtaatcaaagggtctgtcaatgtttttggagctgacatcgacaatgacttctgctacattcatacgggttttcggtcctcggctttcaaagctgtcatttccttcagcatttcaaaggaaacgtcaagtttagacataagcgcaagctcccgttttcttccgtcccggaaatagaaggtgacgacattcgtatccgtgccaaatccggccccttccgctttcacatcattcgcaacgatcatatcaaggtttttctgttcgagttttctgcgcgcatagcgttcgacgtcttgcgtttcagccgcaaatccgaccagcagctggtgtgttttccgttcgccgagttctttcagtatgtctgccgtacggttgaattcgatcacgagcgaaccgtctttcttcttcattttgtgatcagaaacagccgccggcgtaaaatcggccacggccgccgtcttaatcaccatgtcgcatgaatcaaacacagaaagcacggcttctctcatatcggctgccgattgcacaggaagaaactgatacagcccgactggcggctctattgacaccgggcctgaaatcagcgtcacccgcgccccgagacggacggcggcttcagcagcagcgtagcccattttgccggtggatttatttgtgaagaagcggacagggtccacggcttcgcgcgtcggaccggccgtaatgacaatatgttttcctttcagcggcgcatcgtcttcaggctccttaaaatgctctctgacacgctcaacaataagctccggctcctccagccttcctttgccgacatatccgcatgccaaatagccttcactcggctcgataaagcggaccccgtcctgataaagcacagagatgttccgtttcaccgccggatgatcatacatatggacattcatcgcaggcgccacccagaccggggcctcagccgccagcaccgtcgttgtgagcatatcatcagcaattccgttggcaagcttgccgataatatttgccgtagcgggcgcgacaataattaaatccgcccagtcagcggcatcaatatgagaaatcaccttcggattttgttcattaaatgtatctgtatacacttcattccggctcagcgcctgaaatgtcagcggagaaacaaactcacgcgcggactcagtcataatcactttgacatttgcgccggcctgaaccagcttgctcgtgagtgcggaagctttataaacggcaattcccccgcttacgcatagcaaaatgtttcggtttttcatgaagtcttctcctcctttatgaaagcattggacaaatcccaaacggaaaaaaataacaacctatgtagagataggttgctacgtgtgcttgttattcgctgtcttctctttcaaacgaaagcaggcccgcgtcaatttcttctaaagctttgcctacatatttgtgagaaatggtatgttcaatctgctggtcctttttgatctgcatttcacgcgcgcgtcttgcagacacagtcaccagcgtatatttagaatctaatttattcattaaagagtcaattgacggatctaacataagttattctacctccagcattttcttatatctcggagcaacgcgttcacgttttaagtgctcggcgagaacgattgcgttaatcttatcacaagccgtttggatatcgtcgttttcaacgacataatcatacgcgtccatcatttcgatttcagcttttgcggcattcattctgttttcgattaaatcgtcggtttcagtccctcttgtcacgattctgtttttcagctcagaaagactcggcggcgctaagaagataaacaggccttccggaaatgcattccgcacttggagcgcgccctgcacttcaatctctaagaagacgtcttttccttcttgaagcgtctgttcgacataatcaacgggcgtaccgtaatagttgccgacatattctgcccactcaagcagtttgttgttttcaatcatgcgctcgaattcatctctggatttaaagaaataatcgacgccgtcgacctcgccctctctcgggtttctcgtcgtgactgaaattgagtattcaaatttcgtgtcctgttgtgaaaatattgcttgccgaaccgttccttttccaactccggagggacctgagagaacgattaataaccctctttctttcatgcggcaattacccctgcccttcatccataatttcttctttcacagaaagtctgtgtgcaactgtctcaggctggacggcagataagataatgtgatcactatccatgacgacaactgcacgggttcttcgtccgtatgtagcgtctattagcattccgcggtctcttgcatcctggatcattcgctttattggcgcagactccgggctgacaatcgaaatcatccgattggcggagatgatattgccaaatccgatattaatcagtttaatcgtcatcttctacgttccccctgtaaaatagacgtctctagtgtaacctgaagagaccgtctgtaaacaatacgcacagtcgctattctatattttgcacttgttccttcaatttttcaatagaacttttcatttcaacgacaagctttgtgatttgatgatcattggcttttgagccgatcgtgttcgcttcccggttaagctcctgaacaaggaaatcaagtttgcggccgactgccccgccttcttttaatatatcacggaattgaacaaaatggctcttcaatctggtaatttcttccgttatatcagaacgatcggcgaaaatggcgcattccgtgatcagcctgctttcgtcgagcgcgtcctccgtccattccttcattcgggcgtaaagacgctcgcggtattgaataacaacggccgaagcgcgctctttcacctgttcggacagcgtctcaagccgctcaatgtgcagaaagcagtcttccgccaaaagccggccttctttttccctcatgtcacaaagttcctttacagccagctcagcggcttccctgatgacttcttcaagcttgtcatcacgcatctgttcttcgtgaatctgcgcaatatgttcaaatctaaagaaatccattgcatcgggttctgcggccaggctgtagcgctctttcatggcgcgtgcggcgctcacatattcatcaaggagctcccaatcgatgttcaggcttctttttatgagcgcgtcactgttgacagtgagaaacagctctactcttccgcgctgtatatgctgcaatatcgtttgtttcagcttatcctctacatatagcaaaggccgtggcaggcgggcgttcacttctttgaaccggtaattgacggatttcaattcaacggttgccgagagatcgccttttgtgctgcttgcgctgccgaagcctgtcatactccgtatcatatgaaacacccaattctttcccgttatcaaaataaaagggcaatagacatgctattacccctaagattatatcatatggaattatttttttcttgtcaaaagtgaacccgccagcaaaaaagtaggtatgccagacatcccgataatcagcatccaatcgcccggcgtaatcggcactgttttgaaaatcggctgcagcggcggataatagatgacgatggccatcaggaagacagaagaaacgatggcgccgagcagataaatattttcaaacggattccgggagaaaacagacgtttcgctccggcagtcaaacacgtgtataagctgagccaggacaagagtcgcgaatgcaacggtctgtgcgtagggcagattttcaggattgcggtgatagacgatgataaacgctaaaatggttgcggctccgattaaaaaccctcttgatacgactttccagcccagttttctcgcaaacactccttctttcggatgccgcggcttccgcctcatcaggtctccttccggctgatccataccgagggccatcgccggcagcccgtcagtgactaagttcacccacaatatctgaatcgggacgagcggcagcggcagagcgagaagcatcgcaaacagcatcactaaaatttcaccgacgttggaggccagcaaataccggacgaattttcttatattttcatagatattccgtccctcttttatggctgatttaatcgtagcaaagttatcatctaccagaatgagagaagaggcttcctttgccacatccgttcccgtcacgcccatggcaacaccgatatctgcctgctttatggccggcgcgtcattaaccccgtctcccgtcatggcgacgacgtgtccgttttcctggaacgctttgacgattttcaatttatgttcaggtgacacgcgtgcgaagacgtagacatcatcgaccgtttcgataagttctttgtccgtaagctcattcagcgtcttgccgtccatcacacgcccctttttcggaagaagacgcaaatcttttgcaatggcctttgccgtttcgacgtgatcccctgtgatcataaccgttttaatgccggcttcacggcattctttaatggcctgtctgacctccggacggggcggatcaatcatgcctgacaagccgagcatcgtcagatttttttccgcctgctccattgtcggcttttctccgggcttaagcggtttataagcaatcgcaatcgtacgcaaagcttgcgacgccagctctttcagaaccgcttccgtttctgctttcttttctcctgaaaaaggcgtacttcttgcgccgtgcatcagatgtgacgagcggtcaatcagcacatcgggcgctcctttagtgatgacgaactgctttttttcctgatcctctacaatgacggtcatcattttgcggacggagtcaaacggaaactcggcaaccacgcggtaatgcccgctgagccaatcgtttgaatagccgccctttcttgcagccgtcagcagcgctccttctgtcggatcaccgtcgagtacataacggccgtctttcagtgcgatttcagatgtgttgcacaacgcgccgaaaaccagcatctgttcaagaatcttctcatctttcggcttgatttcccgctcatctcgggtgaaaacgccctccggcacatagccgatgcctgacactttataaattttgccgcctgaccacatatgggtgacggtcattttgttttgtgtcagcgtgccggttttatcagaacaaatgacagaggcgcagcccaatgtttcaaccgccgggagctttctgacaattgatttttgtttgatcatgcgctggacgccgattgataatgccaccgtaacaatggcgggaagcccttccggaattgcggcgacggccaatgacaccccggccaaaaacatgctgtaaagatcatgtccctgtaagacgccgactgcaacgaccaataccgttaaaaggagcgcgacgataattaaaattttgccgagctcttcaagtcttcgctgcagcggtgttgaaaggctgccggcggattccagcatatcggcaattttccccattgccgtattcattcctgtaccgacgacgacgccgacaccgctgccgcgcgttacgatcgtacccataaacgccatattgctgatgtcgcctaacgaaacatccggctttctcaatttatcggcttgtttaaccaccggaattgattccccggtcagcgccgattcctcaatttcaaggcttttcgcttcaacgatccgcacatccgcgccaatccggtcgccgcttgaaaatttcatgatatcgccgggaacgagctccttggactgaattttcttccagctcccgtcccgcaacgctgacacatacggcgttgacagctcttttaatgcatgtaaagacttttccgcccgccgctcttgaaaaaaaccgagaaccccattgacaaatacaatcgccataatcgctacggcatctacatattcgcctaaaaacccggatattaaggttgccgccagcagcacgagcaccataaaatctttaaattgggcgaaaaacacggcgatcgccggtgtcctcttgccctcctgaagctcgttcggcccgtgcttttcaaggcgttttttcacctctttttcggtcaacccctgtttaatggacgtatttgttgctttcagcaaatcggtttgtcccatttcatgaaacttcattcttctcgtccactcccctgcctcgctttagagatgtcactctgtaaacaagcttattctgactcgtcccttttcatgctataattatcgaatgcaggaagaaggaaagggtgttttatatgtcttttgatggcatgtttacatacggaatgacacatgaattaaacagccggatcgccggaggacggatcacgagagtccatcagccttttaagcacgatgtgatattccatatccgcgccaacggaacaaaccacaaattattattgtcggcgcatccgagctattcacgggtgcacatgacaaaccaggcctatgaaaatccgagcgagccgccgatgttttgtatgctgctcagaaagcatatagaaggcggatttattgagaaaatagaacaggccggattagaccggattatgatattccgcataaaaagcagaaatgaaatcggcgacgaaaccgtaagaacgctgtatgttgaaattatgggacggcacagcaatattattctgactgacggagaaggatccatcatcgacgggctgaagcatttatctccgtcgatgaacagctaccggaccgttctgccgggctatgattacaagcttcctcccgctcaggaaaaaatttcgccgcttgccgcggatgaagaggacgttttgcgttatctcagttttcaggaaggacggcttgaccagcagatcgtcagacatttctccggtgtttctccgctgtttgcaaaagaagccgtgcacagagcgggtctcgctaacaaaataacgctgccgaagacgctgattgaaatgttccatgccgtgaaagattgcaggtttacaccgaacattacgacagccggcggaaaggaatacttttatctcctgtctctcacacatgtaaacggagaggagcgcacctttcactcactgagtgagctgttggaccggttttatttcggcaaagcggaacgcgaccgcgtcaaacagcaggctcaggatctcgagcgttttgtcgcaaatgaacggaaaaagaatgccaataagataaaaaagctggaaaagacgctcgactactcagaaaatgcgaaggaattccagctatacggcgaactgctgacggcaaatttgtatatgctgaaaaaaggtgacaaagaagcggaagtcatcaattattatgatgaagaaagtaagacggtgaccatccctttaaatccgaacaaaacaccgtcagaaaacgcgcagatgtattttacaaagtatcaaaaggcgaagaattccgtcgaggtggtaaaagaacagatccgtctggccgaggaggaaatcgcttatttcgatcagctgatccagcagctctcctccgcctccacaaaggatattcacgaaataagggaagagcttgtggaaggcaaatatctgcggccgaaacagcagagaggacagaaaaaacagaagcagcacgttcctgttttggagcaatatgaatcttcacggggattgacgattcttgtcggcaaaaacaataaacaaaatgagtacttaacgacaaaagctgccgcgagggatgatttatggttccacacgaaagacattccgggttcccacgttgtgattaaaagcagcgatccggatgaacaatccatactggaggcggctgcgatcgccgcttatttttccaaagcgaaagattccggctccgttccggttgattatacaaaaatcagacatgtgaaaaagccaaacggcgcaaagcccggatttgtcacctatgacagccagcataccgtatttgtcacacctgatgccgaccttgtcatacggctgaaaaaataaacgcacctccaagctgaaacccgcactcggcttggaagtgttttttattacgtataaacggagacgaaactctcccagccgtcagaaccgatctttacagtatctgatcagtttcccgtcatgtctgcatgatccgccgggccgtctgtgatttaaacggtcacacctgatttggcggcggatactttcaccttccctcgccgaacctgagcacatccgggcgggtctctgacctttcctttgtatgcgggcgaaatccaggcggcatcgggatcacatacatattccgcatcacttcgcaatcctgaccgcttgtcggcatataccattcaaactgcccgctttcgttttgaatttttcacattcggcggactgtcaggacagtataaaaaacaccctgcctgatgacagacagggtgttttttatggtcttcttcttttctcaaataatcgatccacttcttcagccaaatcagcagtaatgagaggctttatgtcctcagccagtcttttcgtatgtgcagggcttgcgccgcttgttgatacggatacttgaatgcgccctttgcggatgatcttcggcatatacacgctgccccgttcagcctcgcttacacaattgaccagctgcgtttcagaagcgccctcggttatctcccgattcacgttgcggtcatttgtcgcggcaatgatgaaaaaagcgggcgcgagatccttcatgtcaattttacgggaaacccagcggatacgtccttcatccgccagctgtttaatttcaggcagggcatcgggactgattacagtaatatccgcgccttccgaaagcactgttttgagtcttcttaaggcaacattgcctccgcccgcgatgacaattctttttccgctgagattaatgtgcagaggcagcatactgtccccccttaaaatcaaactgcccgccggggtttcggacagcttccgtcacacggttcaaaaacgcctgcttaatatgcgggtgaaaacctaagtatgaagcgagatgaacattttgattgaccgtttgaagcttttgaacttcccgttcaatctcagtcattaaaagcccggtaaacagaagatatggaacgataaaaacgggtgctccgtcatcctcttcaaggccggcaaacacttctttatagtgcgggtcacatgctgttaaaaaacaagggatgacttctttaacaggtgtaatcgcctcaagttttccggcaatctcactgactgcgcttttaactgccggatctgtgcttcctcttccgatcagcaccactttcgcctgctcaatggacactccggtatcttcaatgcgatgatgcacggcttttacgacttcatcgtccactccgatcggaacaccatatgtcacttttatatcgggatgcagggccgccgcacgggcgatttcagccggaatgtcatgtttcgcgtgggcagcggtcaacagcagcaaaggcacagccgcaatatgagtggcgccttgtctgacacaagcttcaaatcccgcttcaatagacggttcctgcagttctaaaaaacagatttcctgaatgggagcgtcagcgtgtggcatgcacccttttaaaaacgccgccgactctgtctgcgcttttttcagcctgcttccgtgtccgatatataaaatcgcctgcttcatttacaacgcctcgctcaaatccggatttttctgatcagatgcataccagtccagtatgcagtgataattgacgacatcaccgataacaattaaactcgggtttttgatttcttcttttatcactgtgtctgaaagcgtgccgacggtgcagacgactgttttttgcctgtccgtcgtcccccaatgaataaaggctgccggagtgccgccgtctctgccgttttccagcagcattctttcaatctgccggatatttttaattcccatataaatcaccagcgtatcaatgcccgtcgccagcgctttccatttttcttcaaagtcgtcttcttgtttataatgccccgtaacgaatgcgacattggagctcgcctctctgtgcgtcaccggaatgccggcataagcagcagccgcgattcctgatgtaatgccgggaacgatctcaaacggaatggcgttttgcgcgagagcctccgcttcttcgcctccgcggccgaaaacaaacgggtcgccccccttgagccttacaacggttttcccctttttcgcatacttcacaaggaaacggttgatcgtatcctgtttcataatgtgaaaatccgggagcttgccgcagtaaatcagatccgcttcttctccggcgtactgtaaaatctctttgtttaccaatctgtcatataatataacgtccgctttctgtatggctttcattgccttcaccgttaataagtccggatctcccggaccggctccaacgataaatactttccccatagcatgtctccccgatccgttttgaaatcttcccagaacagccgcgaggccgcacttcagctattttaccatatcccgccattgcgggggatatccggctgattgcgcggcctttttggacctattatgctaagctgtttttcacaaagtcaaccagtcttccggtgcattcttcacgttcaaatttgcctgaatcaagtacgagctcaggcgctttcggctcttcatacggtgagtcgatccccgtaaagaacggaatttcaccatttcttgcttttttatataaccctttcggatcgcgcttttcacatatatcgaggtcgcatttcacgtagatttcattaaattcgccctctgccacaagctctctcacctgatctctgtcctcacggaacggagaaataaaagccgtgatgacgatggttccctgctgaacgaaaagcttcgccacttccccgatgcggcgtatattttccttgcggtcatcatcggaaaaacctaagtccttgtttaagccgtggcggatgttatccccatcaagcacaatgacttgatagccttgttcaaacagctcgcgcgctgcggcgtttgcaattgtggatttccctgaaccgcttaagcccgtcagccagaggatagagcttttatgcttgtttttctgctggtattcttctttcgttattgaggcttcatgccatacgatatcacgatttgtcactctattttcctccttaagaaacgcctgcttcttctttcgttttcagccctttaatcaacacctcgacaacttcaggacggctgaattccgccggcggcatgacgccgcttcgcagcatttctctgacctttgttcctgacagaatgacgtggtcttctctgtcatgcggacatgttttggccgttcccatgttgccgcatttctggcagaagaagctgtgctcgaatttcatcggtgtaattccgagttcatccgctgtaaattgatcaaacagctcttgcgcttcatatgtgccgtagtaatcaccgacgccggcatgatcgcggccgacaataaaatgcgtgcagccgtagtttttgcggacaagcgcgtggaaaatggcttctctcggccccgcataccgcattgccgccaaaaacacgccgaggaatacgcggtctttcggataataatgatcgagcagcacctggtagctttccattctgacatccgccggaatgtcatctgattttgtttcaccgacgagcgggttcaaaaacaggccgtcaaccgtctcaagcgcggttttttggatatattcgtgggcgcggtggaccggatttctcgtttggaaaccgacgatggttttccagcctttttcttcgaagcttcgtcttgtatcggcaggttcaaatgtaaactcaggaaactgctttgacgcttttttaattaatgtgatcggcccgccgacatacgtatcgccgcgtgaaaataattttttcacgcccggatgcgcggcatcatcggttttatatacgtgaacggcttctttttgtttatccggcgtataaatatcttcgatgtcgacgacgccgtatgtttctccgccgtaagtcagtttcaccgtgtcgccgacggcaagctcagccgctttttctgaatcgaccggaagcgtgatcggcagggaccagacaacccctgatgctagacgcatattttcaacgactgatacgtaatctttttctgtgaaaaatccttcaatcgggctgtaccccccgatcccgatcagctctaaatcagcgaacgaaatcaaatcaagctcaatttctttgtggacggatgtaagatcatactgctcattcacccgattaattaatgttcctccgtgcggtgctaaactcataatacatgattcctcccagttaacagataaataaactcagattaatagttaaatgcccccgccttgttcatggacagagcgtttctcttttcggatggctttcatcagactggcggctccgccagctgccaaaagcacgctggccatcataaagatggaatagtaatctccttttaacagcagggagacaagcagatacgaaatcgacagtgacaaaaacggcgaaacaacccatactttgagcatcgttttcacgacttctttatgaaaaacgttcggcccgtttttggccattccgataccgataattgatgatgatgtgacttgcgccaatgggaccggcagaccgaagacggaactgataatgacaagccccgcaccggttcctgaaagcagtatgccttctccggctgaaaacctcgtaatctttttcccgttggtttcaagcactttgcgtcctaaaagcagagcgccgagagcgacaaagatgcctccgtacagcgttccttttgacacgctgagtacgcccgcagccaccaaagggcccaccgcatttgcgacattgttcattccggctgaaaaagcttcccaaaaccccgcaaaaagcagcacaattcctaaaatcttctgtttccgtttcgaaatgactcgaatattcagagaactgaataccttcgatacgagaaaagtgaaacagaacgcgacgaacggtacgagcacccaaaaaatcacgatgaccaaaagatgctgtaaaaacaatactttgtacgcgacgccgacaccgacaatcgccccgacagtgacctcactcgtcgacagcggaatgccgagcacattcgccgtgaataacgatagcgccgccgctccgattataatgcagacaatggtgagcgtaatggtttgttcgggaatgattccgccgctgatcgtcttaacgacttcaccgccgccgataaccgcccctgacaggactccggccgcgcagatgatcagcgcatacgttttctttttaacggcgccggacccgtaagcgactcccattgatgccgcggctccgctggctccgatattcatggcaaaaaacagacagaataaaatagcggctaattccatcgggcagctcctttattcatgcagtccgcattctgttttcgccatgccgttccatctgccgctccgcaaatcttccgcggtaaacgcaggtgaagtgcacggttcacagccgatgctcggatacccctgatcatggaggatattgtaatccagctcatgcttggaagtatatctccagatgtctttccatgtccaatggatcagcgggcatactttaatcgattgaaacttgtcgtctttattcaggaaattcgtattcgcccggctcggcccttgatcccggcgaaggccggacagccatgccggatgccctgcgagcgcttctcttaacggcagaatttttctgatgtagcagcactggttcggttctctttcccacagtttatctccgtgagcctcggcctgttcctcgagagtaaggctgggctttttcaggataatgttcagccccggataacgttctttcactttttcgatcgtttcatatgtttctttaaagtgaagacccgtatcgagaaacacgatttccgcgtctttctttactttagaaattaaatcgatcaggacgatgccctcaatcccgaagctgcacgcgtaaacaagctggtctccgtagtggccgtatgcccattttaaaacggacagcgcgcctttataggaatcgtcttccggaaatgtaatcgccggttcctcccatgtatcatacgttagcattttttctttcctcctcccggagacaatcaaacagttgttgttctctgccggttgtcttatccctcaatctttttttcatataaaaaactttcaatccagcggaatgaaagacagtgacccggtatagcccttatcttcaaaatgctgtgcatttttctggatgcggcaccttgcaatacacgcaggttgccgggcgtcatcggtccagtccctcagccgctcttgataagctttttagatttgtactaaattttagcacaattctaacagaagtcaacccgagttttttgataggaataataaaacaggccctgaggcctgtttttattgtcattattttttaaaccaatcttttgactcgggattcagtttccatgatttcagtttttcaatgtcagctgaatgaatcgtaccgttttcaagcgcgacttcaatcagcgtgtcataatcggttaacgagtaataaggaagacccgcttttttaaaggcttctgttgctttcggcagtccgtatgtaaaaatggaaatgacgccgaggacttccgcgccctctctttgaagggccgccgcagcttcaagcacgctgcctccggtagaaatcaagtcttcaatcacgactgttttttgtcctttcttaatggcgccttctatttgatttcctttgccgtgcgctttcggtttgcttctgacgtagcacatcggcgcgcctgtacggtctgcgagaagcgcagcatgcggaatgcccgccgttgcagtgcccgcgatcatctccgcctcggggaaatgctccttcagcagtttgccgagcccgtccgccacatcatttctcacttttggatacgacaatgtcagacggttgtcacaatagatcggtgataaaatgccgctcgcccacgtaaacggctcattcgggcgtaaaaagacagcttcaatgtgtaatagatgttttgcgatagcctgtttcatcggcgaacgccctcccattccagtttaattgcttcatatgctttaacggggttttccgcttttgtaattgagcggcccacgacgatggctgacgaaccgttttctttcgcaaatgacggagtcgccgtacggacttgatcgtcagctgcgtcactggcggtgcggatgcccggcgtgactgtcagaaatgaaggccggaccgcttcataaatggcttttgtttcatggaccgaacataccactccgtccagcccgcactcttccgccattttgccgtaatgcacaaccgtttctaacagcggcttatgcagcagaagctcttccttcgccacctgctctgaagtgctggtcagctgagtcaccgcgattaaagacgggcgttttctgcctgccggcgtgccttcttcaagcccctcaagggccgcgcgcatcatgcgtgcgccccctgccgcatgcacattgacgagatcaacgccgaggccggccagccgcttcatcgctttattgaccgtagtcgggatatcatgaagctttaaatctaaaaatatatcacagttccgttcttttaattggtgaatgatggcggggccttcctgataaaaaagttccatccccgttttgacaaagagcctttccttttcaaacaagtctaaaaacgttaaagtctcttcccctgatgcaaaatcaagcgcgatgatgggcaggttgtttttcatgtttccagctccttccgatgcattcacttacagattgaaagccgtgttggcgcagcacgtgggggagctgttctatgatttccgggcagacgaacggattgacgaagttcgccgtgccgacggcaaccgcactcgctcccgcaagaagaaattctaatgcatcctctgcggtctgaacgccgcccatcccgataatcggaatttgaacggcctggctgacttcgtataccatccggatggcgaccggtttgatcgccgggcctgacagtccgcccgttttatttgctaaaatcggccggcccgtcttgagatcgagcctcatcccgatgagagtattaatcatcgtcagaccgtcagcaccggccgcttcaatcgctttggcaatttcggctatgtttgcgacattaggcgaaagcttcacatacacaggcactgcggaaacttctttcaccgcttttgtcagttcggccgccatgacgggatcagtaccaaaagcaatcccccccgttttgacattcggacatgaaatgttaagctcaagcgcatgcacattcggcgcttggctgatgtgctcggccacttctttatagtcgtccacctgagaaccggcgacatttgcgataatcggcgtgtcaaattgttcgagccaaggcagctcgtgattgagcacatgctcaaggccgggattttgcagtccgatggcattcagcattcccgcgcttgtctccgccactctcggcgtcggatttccgaagcgggcttcgttcgtcgtggctttaatcataatgcctccaaggcatgataaatcgtaaaatccggcatattctttcccgaaaccgaaacatccggaagcggggatgatcgggtttttcaattggagacccggcagattcacctctaacattacagcgccacctcctcagctttaaataccggcccgtcaaggcagacctttacataggatgtatcgctttcacccgtgcggcacacgcaggcgaagcaggccccgatgccgcagcccatccgctcttccatcgaaagataaacctctttatggccgtactgctgcttcagagctttcagcatcggtgtcggtccgcagcttagcaggacatcgaattcgagctgcttttcacggatgatatcggtgacaaatcctttctctccatatgttccgtcagccgtcgccacataagtgtctccgtacgcacggcattcctgttcgtaaaaaacatcctttgctgattgaaatccaagcacatgaatgacgtttacgcctttttccgtcaggcgctttgacagttcctgcaaaggcggaacccccactccgcctccgactaacagcgcggttttgccgggttcaatccgccgcacgggaaatccgttgccgagagggccgagaacgtctattttgccgccctcttttttcccggacaaaaggcgcgttccctcaccgtcagctctgtagataacggatacttcatccgcggcgaaattgacgtccgcaatgctgagcggtcttcttaatagcggtgtgaccgcgtcactcaccttcagatgaagaaattgtcccggctcggtaaggtgccggacaagctctcctttcagcaccatcttataaatccggtcggcaatttctaagttggattgaacagtcaaatgcgcttttttcatatcgtgactgccgccttttgattggtttcggatgcaggcatatgatccgcccggaatgtcatgctttccaatacccgcaaaatggcttcggccgtatctaaagatgtcaggcaggcgactccgttctcaacggattcgcggcggattctgaagccgtctctggccggctgtttgccctttgtcagcgtattgatgacaaattgcgcttctccgtttctgatcacatcgagcagatttttcccttcttcgccgattttcccgacgacttgagccggaatctgagcgtctttcaaataagccgccgttccttccgtcgccaagattttatagccgatggcgtggaaccgcttggcgatcagcagtccttcttctttatctttatcagcaacggtcaacagcactgaaccgtagttcgggatttgaatgcctgaggcaatcagcgctttatagagcgctttttccaaggttgaatctttgcccatgacctctcccgtcgacttcatttcagggcctaacgtgatatccactcttctcagcttcgcgaatgagaagacaggcgctttcacgaacaccccctgctgttcaggctgcagcccctcttgatagccgaaatcagcaagcttttggccgagaatgacctttgtcgccagattcgccatcggaatcttagtgattttgcttaagaacggcacggttctgcttgaccgcggatttacctcaagcacatacacctcaccttgcgaaagtacgaactggatgttcagcaacccgatgatgttaaggccttttgccaaggcaacagtgtattgttcgatttttttcttaatgtctccgcttaaagactgaggcggatagacggcgattgaatcccctgaatggacgccggcccgctcgatatgctccataatccccggaataacgactgtttcgccgtcagatacggcatcgacttcgatttctttccccgtcagataacggtcgattaacaccggatgctgcgggttgattttgaccgcatttttcatatagtgaagcagttcttcttcgtgatagacgatttccatcgcccggccgccgagcacatacgaagggcggacaagtaccggatagccgatggatgcagcgattttgaccgcttcgttcaccgacacggcggtttttccgagcggctgcggcacattcagcgcctcaagcgcctgctcgaacttatcccggtcttccgcacggtctaaatcttcaagtgatgtaccgagaattttgacgccgcgggcgctcaattcttccgcaaggttgatcgccgtctggccgccgaattggacaacaacgccttccggctgttccaaatcaatgatgtgcatgacatcttctaccgtcagcggttcaaaatacagtttgtctgatatgctgaaatcagtggacaccgtctcagggttgttgttgataataatcgcttcatatcctgcctgcttaatcgcccagacagagtgaacggtcgcatagtcaaattcgacgccctgtccgatgcggatcgggccggagccgaggacgacgacgctttttcttgatgttacctcagactcgttttcttcctcatatgtgctgtagaagtacggggtttctgattcgaattccgccgcgcatgtatccaccattttatatacaggcttgatggctgcttcttttcgcatttgatacagctcttgttccggcatattccattcccggctgatatatttgtcggagaaaccgagttccttcgctgtctgcaggacggcgaggctgcctttttccgctttcagctcggtttcaaaagcgaccagcttacagagcttgtgcaaaaagaatacgtcaattgcggaaaactcatgaagctgctccactgtgtagcctcttctgaacgcttctgcaagataaaacagccgttcatctccggcctttctgatccgtttttccaaaagcccgtcagaaatctcttccgcatccttcagttccaggtgatagacatcggcttccagtgagcggaccgcctttaacagcgattcttcaagggtgcgtccgatggccatgacctctccggtggctttcatctgcgtcccgagcctgcggtttgccgactcaaatttgtcgaacggccagcgcgggattttagaaacgacatagtcaagcgcgggctcaaaagccgcatatgtttttcccgttacgggattcatcatttcatcaagagaaagcccgactgcgattttcgccgcaagctttgcgatcgggtaacccgtcgcttttgaagcgagggcagatgagcggctcactcgcggattcacttcgataatgtaatattggaagctgtcgggatcgagcgcgagctgaacattacagccgccttcaatgccgagcgcgcggatcagctttaatgaaacattgcgcaaaagctgatattcccggtcgctcaaagtctggctcggggcaacgacgatgctgtcgcccgtatggatgccgaccggatcgatattttccatgttgcagacgacgatcgcgtgatctctgctgtctctcatgacttcatattcgatctctttgtaaccggcgatgcttttttccagaaggcactgatgaacggggctgagctttaatccgttttcgacgatctctttcagttccgcttcattcgagcagatgccgccgcccgttccgcctaatgtgtaagcggggcgcacgataaccggaaacccgatccggccgacaaattcctcggcttcctgtaaagtgcggatgatctcactttccggcaccggttcattcagctcattcatcagcgtacggaataagtcgcggtcttcagcctgctggatggcggacagctttgtgccgagcacttccactccgcattcctcaagaaccccgagttcagacagctcgacggcaagattcagtccggtctgtcctcccagagtcggcaggatggcgtccggccgttcttttctgataatacgcgtgagaaactccggcgtcagcggttctatgtatacccgatcagccatttccgtatccgtcataatcgttgccggattcgagttgacgagaatgacttcatagccttcttcctttaaagcgagacacgcctgtgtgcccgcataatcaaattccgccgcctgtccgataataatcgggcctgatccgatcactaaaatctttttaatatctacgcgttttggcataccgcttccccttctttctcagttgtttcgatcaagtcaatgaatctgtcaaataagtgattggcgtcttccggtcccggtgaagcttcagggtggtactgaaccgtaaatgccggcaatgttttatgcttgagtccttcgatcgtttgatcattgatcgcaatgtgcgtcacttcaagctctgtctcatctattgaagaaactgtatatccatggttttgggctgttaaagcgactttccctgtcgcaagctctttaaccggatgattggaacccctgtgtccgaatttcattttttccgtttccgctcccgatgccagcgcaaataattgatggccgagacagattccgaataacggcaccttcccgagtatgccttttatcatttcaatggcttccggcacatctttcggatctccgggtccgttagaaagcatgatgccgtccggcttgagctgaagcacttcttccgccgttacattgtacggtacaacgatgacatcgcattttcttttgtttaactctcttaagatgccgtgcttcataccgaaatcgacgagcacgatgcgtttgccgcggcccggactcggatatgccgttttcgccgatacttgagcgacttgatttctcggcagttccgtttctttcagccttgcaagaacctctccgacattctcctcacttgaagcaaacgttccttttaatgccccggccgtgcggatcattctggtgagttttcgcgtgtcgatcccttgtaagccggggatttttttcattttcagatactcatcaagcgtgtaagctgagcgccagttggaaggcagctcgcacagttcttttacgatcagcccttttacaaaaggagtgatagattcaaagtcatctctgttaattccgtagttgccgatcagcggatacgtcagcgtcacgatctgcccgcagtaagaagggtctgataaaatttcctgataaccggtcattcccgtgttgaatacgacttcacccgcggtatgctccaggctcccgaatgcttcaccctcaaataccgctccattttccagcactagtcttcttttcatttgacgagtctcccttcttcatatgcaagcttaccggcagccatcgttgcaacaggccagccgaagcacttcatcttgttgaatggcgtattttttcctttagataaaaatgtatctttgtcaatggccgcttctttgtccagatcaattagggtgatgtcagccggcgcccccggtgcaagcgttccgtacggaagaccgaatgcctcgcaaggttttaccgtcatgaaatcaaccagctgcttcagcgtccacgtcccgtttttcacaaaatgtgtgtacagaaggggaaaggcagtttctaacccgacaataccgaaaggcgcaagcttcatgtccgtgtttttctcttcttctgtatgcggcgcatggtcagtggcgatgaaatcaatcgtgccgtctaaaagcccttcaatcagcgcctctctgtcctctttgctgcgaagcggcggattcatcttaaaattggtatcaagtcccgggatatcttcgtcacaaagcagcaggtggtgcggcgatacttccgccgtcacgcggatgcccgctttttttgcgtctcttacggctctgacggattctttcgtgctgatatgacacacgtggtaatggcagcccgccgcttccgccagcagcacgtcacgggcgatatgtaccgcttcacaaatggaaggtatacccttcaggccgttcgcttttgaaaaagaaccttcatgcacgctccctccgtaaataagtgagttatcctcacaatgagcgacaatcgctttatttattgaagccgcccgtttcatggcttcatacatcattccggccgtctgaactccgacgccgtcatcggtgaaggcgaatgcgcccgcttcatgaagcgcctcaaaatctgtcatctcttcgccggtttgtctgatcgtaatcgatgcgtaaggaaggaccctgacagatgaggtttctttgatcctgttttgcagccattccatctgctctttcgtatccggcaccggccttgtattcggcatggcggcgactgtggtaaaaccgccccgcgccgcggctttagagcccgtctcaatggtttcttttttctcgccgcccggttctctgaagtggacatgaaggtctacgagcccaggtgaaacgaacagtccctcagcgtcgatcaccgtttctccgtctttcgctgtcagaagcccggtttccgaaatgaattcacccgttacccggatatcatgtaccgctttttctccctgttcatttaatatccagccgtttttaatgagataagacataagccgcttctccccttttcacattggtttgcagtgctctttttaagactgccattctgatatacacaccattttccatttgtttaaagattcttgattttccgcattccactaatgttgtgtcaatttcgactcctctgttcaccggtgcgggatgcatgatgatagcatgccgcttcatgctctgcgcccgcttttcggtcagcccgtatgcttccaggtagcctttttggtcggcttctgtctgatgcctttcattttggatgcggagcagcatgacgacatctgaagcttgtatggcctcatccgtctgaacacaggtgccgaaggcgtttttctcatcctgccactgcggcggcccggaaaacagcacacgtgcgccgagccttgtcagcacctcggcatttgaccttgccactctgctgtgtttgatatcgccatgaatggaaaccgtcaggccctgaaaggtctcaaattcctcttgaatcgtcattaaatcaagcaatgactgggtcgggtgctgtccgcagccgtctcctgcgtttaagaccggaatattgactctgccggtcagatctttgtaatattcatccgtgctgtgcctgatgacgcaggcgtccgctccgattgattccagtgttttgaccgtgtcgtataaggactcgcctttttgaacgcttgtgctcgtgccgtctaagctgagcacgttcatcccgagtttcttttccgccacttcaaagctgaaccgcgttctcgtgctcggttcaaaaaacagattcgcaacgaattttcccgcgagatcgggacggactgcaccctcttttatcgcttttgcctctcgcagcagttctgtaatttcagccgcgctcagttcagacatcgccgttaaatgattcatgttttttctcctccgtttccgcttgaaggccgtaaaaaacaccccggtctatagactcggggtgcggttaaagagagaagagccgtacagcgtcttcccgttataacccttccaagcctctctggactttctttaaaaggtttacatatgatttagtttttccgatgcaatcgcgtcttcttcatttgcatgcggcaggataaggttcaggatgactccgacgattgccgcaagcgccatgccggatatttggaacccgccttttgatacttgaataaaagcccctccgacgccgatcacgaggatgacggatgtgataattaaatttcgcttgttttcataatcaatgttgttgtcaatcagcattctcaagccgctggaggcaatgattccgaagagcaggaaggaaacgcctcccataaccgcggacggaacagagctgatcagcgctgaaactttgccgataaatccgaagcacagcgcaatcactcctgcgccgccgatgacaaagacgctgaaaactctcgtaattgccaggacaccgatgttttcgccgtatgttgtcgtcggcgggccgccgattaacgaagcgataatcgtcgctacgctgtcccccattatggagcggtgcagtcccggctttttaataaaatcctgtccgacgactttactcagcaccatttggtggccgatatgttctgacatcgtcacgaaagcgaccggcaccatcgcagcggcaatgcccaatgtcactgacggcgtgtagtctttgaaagggatgataaattcaggaacggcgaaccattttgcatcaatgaccggctgaaaattgacgatgccctgtgtcagcgcaaacagatatccgcctataatgccgatcaataccggaatcaagcttaaaaatcctcgtaaaaagatggcgcagataatggtgatggccaaagtgacgccggctacactgaaatgtttcaggctgtaaacgagttccttcgcattcggatcagcatacattgccatattgacggctgtgcttgccagtccgaggccgatgacgatgatgaccggcccgacgaccaccgggggcagcagcttcatcagccaccccgttccaagctgcctgatgagaagcgcgatcaggccgtacacaattcccgccaggaaagcgccgaccatggcagcccccggccctcccgtcgccttcaccaagataatcggtgatataaaggcgaatgatgagccgagataagcgggaatctggccttttgtcaccaagagataggcgagtgtcccgattccgctcgtgacaagcgccactgccgggctcattccgaccagtttcggcacgagtatggttgaaccgaacatggcgaataaatgctgcaggctgaatgacagccaggacaatggattggggacgtccctgactcccaggtttacttttttcttactcatggcgttttcctcccggttgactttcaaatggtataaaaaaacctctttgctttttgcgcaaagaggcatacaaagcccggccgtgtcgatccgcccggctttgtgttttaaaatcctctttgcaaactctctggaatgcatttaaaaagggtggttattcattttcgtaaatggcgaccatatcagtctgatcaacttcgctcagctgaaccatcactttttcagcttttgaggtcggaatgtttttcccgatatagtccgctctgatcggcagctcccggtgtcctctgtcgacaagcacggcaagctgtatcgatgacggccgcccgacatcaacgagagcatccatcgcagctctcaccgtccggccggtataaagcacatcatcaaccacaatgaccttttggtctgtgatatcggccggaatgtccgcgccttttacaagcggctcttcattgctcgttttttttgtgagatcgtcacggtaaagggtgatatcgatttccccgacggtgaccggatttccttcaatctgttcgatccgctcggccagccgcttcgctaaataaatacctcttgttttaatccctacaagaatgcagtcattcattcctttattccgttcgatcatttcatgggctatccttgtcagcgcccttctgatggcctgttcgtcgagaataacagctttttgattcaatcgtgacacctctccattcgtatataagaagaaaaaacccctcctgccagagcatagaggggttcctttccaggaccaagacacacgtgtatctcttctgtcctatccgttatccttctcagcctctctggactgtgttaaagaatctattcagcttgtttttattatttcagaaaagaaactcgctgtcaatggctatttctcaaatgttcaatgagttttttcatatcttcaggaaggggcgcttcaaactccatgtattcgcccgtccgcggatggtcaaaacctaatattccggcatgaagcgcctgaccgttgaaatcaatggtttttctcggtccgtacttcgggtcgcctgccaaaggaaatccgatatatttcatatgaacacggatctgatgcgttcttccggtttcaagacggcactctacgagcgtgaagtcttgaaaacgctcaagcacgtggaaatgcgtgacggcgtttttgctgctttctcttgttacggtcatgctttgtcggtcttttttatctctcccgatcggagcgtcaatcgttccgtcatcatgtgaaatcaacccgtggacaaccgctgtgtactttctcgtcacggttttattgacgagctgattaacgagtgattcatgcgccatatcgtttttggcgaccattaacaggccggaggtatctttatcaatccggtggacgattcccgggcgcatgacgccgttaatgcctgaaagatcgttgcagtgagccatcagtccgtttacgagcgtccctgtcacatggccgggcgccgggtgtacgaccatgccccgcggtttgttcacaaccaagacatcctggtcttcatagtaaatgtccaaatccatcggctctgcaagcacgtccaattcttccggttcaggaatggtgacgtttacctgatcgccgggctgcattttataattcgcttttacggatttgccgttaacggataccagtccctcttttacccattgctgcacttgagtgcgtgaccagttttctcccgttgaagccaaaaatttatcaatccgttcgctcttttgttcaggctgaacggttatctcaaattgattcatgttattgctccttctttttcccgctgtcaaacagcatatgaataaataaaagtattacaccgacgcacagtgaggagtccgcgatattaaaaatcggatagtgataatccacgatgatgacatgaataaaatccaccacttcctggcgcgccgcccggtcaataaagtttccggccgcacctcccagcattaagccgagagaaattccgagtaacatctgcccttttgcataacgctgtatgtaataaacgattccgataatcacggcgatggtaatgacgtagaaaaaccacatttggccggctaaaatcccccacgctgctcccgtgttgcgatgagatgtgatataaagcacctggtcgatgacaggtatgctttgtcccaattccatatggctgacgacaagccatttggtcaattggtcggcaataataataaaaagagcgataagataataaagcacacacgttcctccagtatacagttacttttatcctttatgaattttatcagtaaaagatgccggagtaaaggcagatcataagcgtatgcaaacagacgctgtcactcatacagcgcctgatcatatgcataatctccggttacccagtatggaagggttttcttttcaaattgagcgggataataaaaatcatcagcggttctggccgtcggcagcaccgcaagtttttcaatcggaatgggggcgcctgttttttcacaataaccgtacgtattgttttcaaacttagacagggcaagaagaacatcctgaagttcttcttttatatgatagatcagagttgcttcttggtcgttcattgaaggttcaacagatgctgacatttgaaagcaagaatattcgaataatcttgattgaagttcttctttcatcatgagaagctccgtgtggattgcggtcagttgatcattcattcatcacaactcctgctcttgatgttatagctttattgttgccctcagagcgctatttgaagcccataagaattttcctgccgttctaatcgatgacattgctggcatgtaaaaaagcgcccggctgacaccgggcgctttctcatttattatttttgataatatttttcaacgatttccgcattgcgcagtgataatgtcggatatttcggattggctccgacatctttagaaattacgcgggaacgctcacacatctggccttccgctttttctacggtcatttttcctgttgtaaagctttgcgcgttttccggcgcttcactttcgtcttttactgtcagttctgagacgataaacagctgcgcgatgttttctttaatggatgacaagaggtcgcggttttctttgttcggatacaaagtaaggctcgcttccaatgatcttccgataattttttcgttacgggctgtttccaaagctttcagcacgtcgtttcgaagctccatgaagcggtcgaatttttcttctgtcgcctgactgtccggaacagcaatggtttccggcatatctgtcagctgcacgctcgcttcttcaacaaatgataagtgagaccacatttcatccgccgtatgcgggagaatcggcgccgtcagtttcactaacgccagcagcgtttcataaaagacggtctgcatgctgcggcggtccggatgatccgcatgctcgatgtacacaacatcttttgcaaaatcaagatagaaggagctgagctcgatcgtacagaaattgtgaatgctgtgataaacaaccgcaaattcgtattcatcgtacgcttttttcaccttatcgatcagcttattcagcttgatcagcatatattgatccacttcgcggagatcttttacatccacggcattgatgcttggatcaaaatcgaacaggttgccgtgaaggaagcggaacgtgttgcggactttccggtatacttccgcgacctgcttcagaatatcttcagaaaccgggtgatcggcctgatagtttacggaagatacccataaacgcagaatttcagctccaagctgttttgcgatttttgtcgggtcaatcgtattgccgagtgatttactcattttacggccgtttgcatcaagtgtaaatccgtggcttaatacgcctttatacggcgctttgccggtgactgcaacagcggtggaaagagatgagttaaaccagccgcggtattggtcagagccttcaaggtataaatcagccggacggacaagatcatctcgttcttcaagaacggcctgatgggaagaacctgaatcaaaccatacatccataatgtcttgctctttcgtgaagattccgttcgggcttcccggatgtgtaaatccttccggcaggaggtcttttgcctctctttcaaaccatacgtttgagccgtgctgtttgaacagctcagacacgtgttcaatcgtttcgtcagtgatgatcggctcaccgttttctgcataaaataccgggatcggaacaccccagacgcgctgtcttgagatacaccagtcaccgcggtcgcgcaccatgttgtaaaggcgctgttcgccccactccggcacccacttcgtttgtttgatggcatcaagcagatcggatctgaaatctttaattgacgcaaaccattgcgcagtcgctctgaagatcgtcggttttttcgttctccagtcatgcggataggagtgtgtaataaactcgagtttcaaaagcgcgccgttttcttcaagcttctccgtgatcggtttattggctttatcgtaaaacattccttcaaagcccggcgcttcgtcggtcatgtttcctttttcatcaacagggcacagtacttctaagccgtacttttggccgacgataaagtcatcttccccgtggcccggggcagtatgaacacagcctgttccggcatcggttgtgacgtggtcaccgagcatgacgagtgaatctctgccgtacagcggatgttctgcagtgatgtattctaattctctgcctttatatgatgcgacaacttcaggattttcaaagccgcatgcctccgctacgttttcgatcagttcagccgccactacataacgcttgtctccaaccttgatgacattgtattcaagatcaggatgaacggaaattccgaggttggcaggcatcgtccacggcgtcgtcgtccagatgatgaagctttctccgttttccagaacgcctttaccgtctttcactttaaacgcaacataaatagacgcggaacgtttgtcctgatattcaatttccgcttctgctaaggcagattcacttgaaggcgaccagttgaccggcttcagacctttataaatatagcctcttttcgccatctcgccgaaaacgcggatctgctgcgcttcaaattcaggctgaagcgtaacatacgggttttcccaatcgcctctgacgccgagacgcttgaattgttcgcgctgtctttcgatctgctgccatgcataatcttcgcaaagcttgcggaaatcagcgacggacatttctttccggtttacttttttgtttttcgtcagcgccgtttcaatcggcagtccgtgcgtatcccagcccggcacgtacggtgcgttgtagccgctcattgatttatagcggacgatgaagtctttcaggattttgttcagggcatggcccatgtggatgtctccgtttgcataaggaggtccgtcatgcagcacgaatttcgggcggtctttcgtccgttcttgaacaagacggtaaatgtcctgctcctcccagtctttttgcatgtccggctcacgattcggcagatttccccgcatcggaaaatctgttttcggcattaacagcgtatctttgtaatccattttcattcctccacaacatttttcagaaaataaaaaaagccctctcatcccataagggacgagaaagcttatctcgcggtaccacccttttagaaaaaacggatcatccgtcttttcctctcgaacatcgtaacgtgatggaacgtcctttcctactctcggttcagaaaggaaactaaagggctgatctgcatgattccggccatcccgggctttcaccttccccggttcgctttatagcctgttttgagtcatgccggtccctttcaatcgtcttttcatctgaatttatgaacgtattatattcgaacgggccgaagaatgtcaagaaaatcagaaaattattctttttcctcaaataccgcgtcgacttcgtattccagcagatgatcccaatcatcgttcttcagcaggtcgagctgcgcttcaatcagcatttggaaacgtgttctgaagactttagactgttttttcagctcttcgatttccattgcgatttttcttgatttggaaagcgactcattgatgatgcgatcggcatttttttctgcttcacggacgatcagcttcgcttctttctgcgagttgcgctttacgtcttctgcggcttcctgggctacgagaattgatttattcagcgtttcttcgatattggcaaagtggccgattttttcgtccagctcgttcactttcgcctcaagctccgtttttttacggagtgcgatttcgtaatcttttctgacctgcattaaaaattcatttacttcatcttcatcatatccgcgaaaaccttttgtaaacgttttgttatggatatcattcggcgttaatggcatattgccacctccatttttacatttcagtacggttatctagttcacattataaaacaaatacggcacagatggagaaaaaaactgaaaaaacgactcatttttgccgttcaaatgtaactttccatttgtcttttttcgtttttccgtcaacttttgccaaactgcatcgtccgaagccgcgaatcgagagcatgtccccttcagcaacctgataagacggatcttcaatagctttccaattcaccttaacgagcccgtttttcacaagcgcctgcgctttctgccgggattgcctgctcattgaagcgcagacggcgtcgagacgcaatgaagaaaccgtgtcatcccttatttcgacatctgaagcgggaatgtgaagagcggaaagctcgattttctcaagctttaccggcgctttgcccgccttggtcagctgagtgctgacaaaatcggcgatttcaccggagacgatgagctgcacggcttcctctgagaaaatcagatcgccgtatttctgccgctttaagccgatccccattaatgatccgagaagagagcggtggtcaatgctgacgaatttttcagcgtattgaacgtcaaaagcccggagctcaaaatcatcctgttcaggttccatatattcagggtataaaatcgcgcgtttgcgctcagctctgtcatatcctccgaaaaacgcaagaccgcaggcgtcgccgataacggcttttacaatcacctgttccctgggatctaagaaatcagtcagcttcatccgatactggtccaggacaatctgtttccattcaagcacctgatcaataaaaggccgctcgtcttgtctgaagtgctggtaaatatcgctcatgttctttcctttctatgtaaagaggcttggctggtgccaagcccgtatcaaactgtcgcattcaagtatacattgcgatcatgcggtataggccccaaagtcccgtcgtggcaaaccgaagcacgataatcgctacaatcggggatatatccagcatggcaatgggcggaatgatccttctgaacggctctaaatacggttcgcaaatcgctgcgagaaaccgtccgaccgccgtttctctcgtactcggcacccatgacataaagatatagatgatcagggcaaacgagtagatgtaaattaaataactcagaacggaaaaaatttgataaagaatcatcctgctttaccacctctgatgttcgtcttcatttataagctccgaaatcgtgccggaaacgtcgacattatcaggcgtgcacagaaaaatatctgaaccgattctctgaatgtcgccgccgatggcgtagacggtaccgcttaaaaagtcgacgattcttttcgcctgatcatgctggatgcgctgcagattgacgacaaccgcccgcctgttctttaaatgatcggcgatttcctgcgcttccgcatatacacgcggttcactcaagaccactttagaggatttctgaacactttgcaagcttactacgttctgcttgccctgcggcttctgagcgtaagcaggctgtttatctttctgctgttcatgctcttcctgatgatcctgctccgtttcaatgtattcgtactcgtactcctcctcatccattgagaaaaagtttttcagtttatttttcatgctcatttgtttacaccccccggttcatttccgactaatgaagagccgattctgataaaagttgcgccctcttcaacagcgatttcataatcatttgacatgcccattgacagttcccggcacggcgcgtttgtctgattcagtttttgcacctgatccctcagatcacgcaattgccggaagcaggctctgatcgtttctgtatcgtctgtcaggggagccatcgtcatcaggccctctacagaaatgtttctaaactcagaaagctctctgataaaggggatgacctcctctgttttcaaaccgtgcttagacggctcaagcgaagtattcacctgcacaaaacagcgaaccgtatgctgcgcccgtttttcaatctcttttgccaatgacagtctgtctaaggaatgaatataagatacacggtcaacgacggccttcacctttctggactgaagactgccgataaagtgccacttcgggcttcctttgatgacttcctgcttatggataagctcggcatcccggttttctcccagacttgtaataccggcatcaacggcctcttgagccctttcagctgatacgtattttgtaaccgcgatgacggtaacatcttcggggcttcggcccgatctgttacatgcttcgtttattctttcgtttatatgtcgtaattgatcagcaacacgcaagatctaatgcctccttcattccgataaaggacatcatgcgtcccgttttccctttgtcgcggcggtgtgaaaagaatagttcatgctctcgttcggtgcataatccgctgactgaaatgttttcttccggaatgccgcaatgtatcagaagaagacggttgacctcttttaaatcaagctgatactggcctttttccgtttcgcatatggcggattcagccgtaaagggcagcgcccgcacttcattgatgacgcggtcgtcgactgtatagcttcccgcgctgatggacgaaccgatgacagcctgaatatctgttaaacgggagccttcttcgtttacccagcgttccgtcatgatgcgtccgatttgtttgaccgtccccttccatccggcatgggcagcgccgataatggatttcaccgggtcataaaaatacaagggcacacagtccgcaaaacaaagggccaaaaaaagattcgcatctttcgtgtagagcccgtccgtcccgcggaatgcggaagaatagtctctcgctccttttcctttatccccggctgtcacgcgccggacgcggttttcatgtgtctggtcggcgaacacccaggaatccagatcagtaccgcataaggacgctatgacttcacggtttgtcacaacatcatgagcttcgtcccggacgtgcaacccggtatttaatgactcatacggaggattgctgacaccgccgtttttcgttgtgaatccggcgatgacctttgtgttaagctgattcacacagttccagtcttctatcatgagtgccgagggggtggtaagactaaacgggtgatatgtattcatggagatccaacctttcgacaaacattaaaaaagcgtaatttcccactcattttaacacaattttaagcatacgtttagcggctgattgaaaaatgagataaataaatgtgccggaaacattgagatttccggctttttacaagtaaagggaggattacgctcccccctttggttcatttacacgcactaagatgacatcttccccaattttaactatatttcgccaaggaatgatcatttcctcttcttttccgaaaaaaccgagaacttttccgctgccgcctaaaataatcgcctgaatttttcccgttgtcacgttaatatcaatatccccgatgcttccgagtttttttccgttcgacacgtttaccacatcttttatttgaaattcagatatgctgatcatccgtatcacgccctttgcccgttctttttcctattatatgaacggccgggctgaaccttgtcacatcgggcaatcttttttgcggctgcaccagccgagaataaatctcagcatgattttcgtatagtccataagctcatcaacggacacttcctcgtttacggagtgggcgttttttaaatcgccggggccgtatatgacgctcggaatcccggcctgataaagccatcctccgtctgttacggtttgggaaacatcaatgacgggctcctgttttatgacggcagagtgtgatgcagccaagacagaaactgccggatgatccggatcgatttccagcgccgggaacacctctcctctgtcttcaatcatcgaagatccgccccatttgaacaccggcctgttttctttgagccacagatcactgtcagcgacacgattaatatagtcttcgatttctgcggctgcttgttcgtgcgtttcgttcggataaaagtggacggtgatccataaccggcattcatcggcgacaaacgctgcgtgtcttccgccttcaatgacggcggggttgatcgtattggtgccgggcgcaatgccgggatagcttttcgttaccgcccagtggcgctccagctctcccaaggcagtgatgattttcgccattttttcgatggcgctcgctccgaatgtgcctccgcccgcatgaatcatattgcgcctcatgccgtcatgaaatgtttgtttgcttttcaattctatccagccggtgatgacaccgccctgcccttgaatatgcaggctgctcgtatccgcgacaaccgcaaaatccgcgtgatagccgcgtttgcagcattccagcgtccccgcctcgccgacttcttctccgattacagactgtacaatgaggtcgcccggaagcttaattgcggcatcatggatcagcttcagagagaaaagaacacacgccaacccccctttcatatcagcggcgccccttccgatcagcatgccgtcttttacgagcggctgaaacgggtcagagttccaatcttcgcccccggcttctgccacatcaatgtgtccgtttaaaatcaggctttgatgcctgcttgaatctgtcccttttaaaacaccgactacattcggatcttccggatacacatcccacatatcgaccgagcagcccgtttcttttaaaaagccggccacccacttttgggcttctgccgtatttcttgctggcggggccggagtgggaaaggcgatcaacctttcagcaatatgtatgaagtcgtgcctccgtttctccgcctgttgtaacagcatatcaatctgatgcattggaaatctcccctttagctgtatcaaaaaacccgtttcattaaaatgaaacgggtaaaaaacggatcttcctccgcttttttcaccgcttccctccgccggcatgatccggatcaggtccgttaagggttgagacaacgtctctctcagccgcatggcagcacccccagggtgaattgatgttattttacggttgatgcctcttttgcacgtgttaaaaacgggcggccattgttccataagacattgacaggcgtatcgaaaaacgctgtaagccgctcgtcagaaagcatatccctgattttcccggaggcgaacacctcgccttgttttaaaagcagcgccttatcaaataccggcagaatttcttcagcgtgatgggtgacataaaggatggacggcgcattttctttttcggcgatcgacgtaatcgtgtccagcagctgctcccttgccataaaatcaagacccgtcacgggctcgtccaaaatcagcagtttgggatcagccataagcgcccgcgcaatcagcgctctttgtctttccccttgtgataatgtttcataccgcctgtcggcgtaactgatggcgcccaaatccttcagaagaccgatcgctttttcccttacctgctcactcggagtttcgtacagcccgattgaggcgtacgcgccgctgagggcgatttcaaaagcggagtccgcggcatataatttgtgctgaagacctgccgaaacaaggccgattttccttctgagcctgtcaccgagctctgttttgccgaactgatggccgagcacctgcatctctcctgaagtggggaagtaataagagcataacatattcagcaaagccgtttttccggctccgtttaatccgtacagcacccaattttcgtttttctcgacgcgccagttaatatctttcaaaatccatttcccgtttctttttaatgacacactgtccagctgtaaaatcattgccgtttcccccgtttactttatttaaattttctaaaaacttttacacattagaatacatcacttttttgcaaacgtaaaccatcgcatgaaaaaagcctttaaacaaggtttaaaggctttttccgttattgatggatattcttattcatttgtttaatggctgccttttcaagccttgagacctgagcttgggatatcccgatttcttcagcgacctccatttgggttttcccttggaaaaagcgctttcgcaaaatcattttttcccgttcgttcagtcttctcatgccttctttcagagccagctcctcaatccattgtgtatccttgttgcgctcatcgctgatctggtccatcacgtagatcggatcgccgccgtcattataaatcggctcaaacagtgaaaccggatcctggatggcgtcaagggcaaacacaatttcttcatggggcacttcaagaactttggcgatttcctctgctgtcggctccctgcttgtctcactgattaaccgctctcttacttgaagcgctttatatgcgatatcgcgaagcgacctcgagacgcggatcggattgttatcccgcaaatatctgcggatttctccgatgatcatcggtacagcgtatgttgaaaacttaacattatggcttaggtcaaaattatcaatggatttcattagtccgatgcagccgacctgaaataagtcatcaacatactctcctctgttgttaaacctctgaatgacgcttaagacaaggcgcagattgccgtttacaagcttttccctcgctgaatcatcgccctcatcctgcaattgcctaaacagctttctcatctcttcattcttgagcaccggtaatttggaggtatccaccccgcaaatttcgactttatttcttgacacgtttttccctcccactaggagctgctgtacaacgttaagtatctcctcgggtgggaaaaatatgcaccgctattttacagaaataaacatccggcggcggcaatccttgcagcagtaagggctgtcagatggaaaaaattttacaccattttgttaaactcttttctcagtcttttgataatccgcttttcgagccgggagatataagattgtgaaatccccatcatgtcggctacatctttttgggttttttcttcttctccgacaagcccgaaacgcagttccataatctgcttttctctttcgtttaattgctcaagcgcttttttcaaaagttttttatccacattggcttcaatgtctttcgtaataatatcatcatctgtgccgagcacatccgaaagcagcagttcgtttccgtcccaatcaatgttcagcggttcatcaaaggacacctctgaacggattttattgtttcggcgcaagtacattaaaatttcgttttcaatacatcgcgatgcgtaggtggcgagtttgattttcttttccggattaaacgtgtttaccgctttgatcaaaccgatggtgccgatgctgattaagtcctcgatattgatgccggtgttttcgaatttgcgggcaatgtaaacgacaagacgtaagtttctctcaatcaggatggcccgcgccgcctgatccccgctcggcagctttaataagagcacctgctcctcttctttagacaaaggcggcggcagcgcctcgcttcctcctatgtaatacacttcatcgcttttcagtccgagtttcatcagccatttataccacaaatatgtcagacgcagcttaagttttttcatcttcctcccccttctaaataccacgcgttttgagtatgatgaataacagacttttcgtcaggaaacatgttttacagccttccctgtcagcatcttcggatgaacgattccgtcaaattcaccgtcagcggataatggcttcgtgctgatgccgatcaggcatttttcacatgcgatcatctcgtcttttgttaaaatcgtgacgtaatccggctttaaacagagtaaaaattgattgtcctggccgacgcccctgtatggaatcagcctcagcttatccgcatggcggaacgaatcatcaagctgctctatcacttcaagcggactggcggatttgatgaagtccgtttccttttcgctgaggatcggagcgaatttgttaatgtgaaggatcatgaccggcgttttcgtcagcggatcatacagctgattcccggaatccaccaatcctttcgcgcggattgtctgtccgctgaattccgcctgcaccatgacaagttcatcgtactgaatggacttcgtctcgatgtcttcaattctctttttcgaaaaaaaccatatggccggaaatccgataactacaaacatccagctgatcgggtcgccgaatccggtctggcttgtaaccattacgccttgctgcacaattgattctgtctgcagcagggaatgtacgccgatcattcccccgccgacgagaaaagtcgcgaaataaaaggcgaacaaattttgaaaaaagtatcggaaccgtttaaagccaaaagccgtaagcacgatgactaccgaaaacgccatttttcccgccggatgctccacaaagggagaaataggcgtaaacatcagaagcacaatggctgacccgatgaaaccgccggcggccactcttctttttttcacctggcgttttaaaataaaggcggtcaataaaagcaaaagagaatcaaaacaaaagttcaacagccaaatgacatccagatagattttcacatctgacccctttcctcttttgtcttacatatctgtttctctctcttgtttcataagtataaagcaagctctgtgggaaagtctgtcaattaatgttgagggtaaagtacaatttttaagggataaccgttttatttgtcgagggccgaaaaggttgattttctattgtccccttcaactaaaaaagcgctgccgtgatttggcagcgctctgtttttactcattgatataaagttttcctttagccgtctgtctcgtttcatttccgtagtcatctcttgcgataacgtcaatttttgctccgcttgctttgatggaagaagccgccgtccagtaaccctcatatcgtcccggagaaatttctctcagcggaagctctgttgcgttttggctccctgcccgggcgtttgtcagaggcagacggatcacgaaggaagcgtctaatttctttccgcttgaaaaagcgattttcactgattctccggcttttaattccttatccgctccgggaaccaatccggaaatgacgggagcattgtaattgacatcgattaccgtctttttcgttgttttgttaccagcttcatctgaggccgtgaccttgatctcattgctgccgttttccagaagggttctcgcttgataagaaccgttatttacttcagctttttttccgttcacctttacccattttaaatgggcgtcgtgcacttttccttttacagtcactgcttctttatttgttttatcaccgtttgccggactgtcaatcgtcacatcaggcttatcctcatccagtatgaccgtgacagggcgtgactcgtcggttgacccgctgtctgtcacagatgccgctgtcagccgattgccatctttagtgagtgtgacaccggcctggaaactgccgtctgcatctgctttcgtttctgcggcggttttaccgttattggtaagacggacagcggtttttggtgaagccgttcctttcaccgtgattgacttcttgtttgtaaatgaccggttttcaggcgacgttatctcaggcacagaagcttcgtagtcgaccaaagccctgatcataaagtttccgtctgttttatcggcttttgaccagcggccgtcgaggtattgccagtttctgttcgagtacgggctgccgtcatcagatgacagggcaggtgtataaggatcgggtttcgtctgacggaacacaagataaaaatcctttccgaccgcgattccttttgagctgagatccactttggtccactcgccgtttcgaagcgcttcagcttggaacgggccggcaattttgctgcccggagctccatcagggccggatgcatcatatacttctgcttgaaattcggtaccgcccggatcaggccagtcggcgccccaaaatttaaaaaggcctcccgtcagcataccgtgttcttttccgtctttgagggtcatcttaacggcagatttgctgccggctttaaaatatgacagcgcggcttcttccgtcccgttatcataggcgatttccccttcataaccgacatacggcttaagcttgacgtttttttcagcatctcctttgatgtcgacagaaaattcgctattgtaaaagccttttgccgctactttgattgtgtaggagccttcatacgccttaagcgaatattcccctttatcgtttgtcaccgccggctcaattgcggcatcctcggccacataaagcgcagccccttttaccggttcgcctgtggactgattggtgatggttccttttagcgtgccggacggcatttgctccagtgtaaagtctgcctgtgcggttttgtctgattgaatagaaacttgtttcgaagcggacttaaatccgtaagcctcggctttcagcgtatagcttcccgccttatgtgacaggctgtaacttccgcttgcagggtcggaatatacggatttccccgtctcggcgacactgatttgcgctctgagcggcaggaggtttgtttcacgtttcactctttttccgggtgatttcactgccggtttggcctgtttcggactgatggcttttttcttcaggtggccgggaggtgtttgtctattgtgtttactttttttagccgccttgccgagagggctgcttgaaagccggatatcatcgatataccatccgtcttcattgagtacttcgtcagactgcatattaaacatgagctttatgttttggcctttatacgcagataaatccgcctcttcatcattccatcctgcggaatcaccattgtaaacggccgcctgctcccaatttgatttcccttccggcagaacgaacacatacccgtaatcaaaaaattcttcgagcttgtgccagcttttaaattgtaaaaacagccgccctgtttccggaacttgaatcggaggcatcacgagattcatgttggccgaatcggcataagggccggacagattcgtcgcatacactttatctccggaaaatgcggcgccgggccctgaacccgggataccccattcccattgatcatgtgtcccgtaactggaccagcccgccggctgtgattcaaaatcctctttgtatcccgccgtaatgctcggtttcacgtcagcccggtacgtatcagattctacagaatgacctccgaaatcttttatggtccatttataacttatcttgcttcccgttatgtccggaatctccgcctggtatgttccctttttttcatcaccgcttttttgaacggcggctgtcgttttccactctccttcatcaaactgataggagaggatcacctcagttatgcttacatcatcttctgctgtaaccgttaacggaaggtttgcccctttgtaagcctctgagaccggttcatgatgaaagctgggcggattgtgatcttcacccgcagaagataccttgccttctacgcttccgattccgtccgttacggcagaaacggcatcaaaagcgttaacgaggccgtggccgtaaccgttattcggtgattccggaaaaacggaatctgtcagcttttcggcggtgcgcgtcagaacgtcttccatttcatcgaccgtaatagaggcgttcgcctgccttaacaaagccgccgtcgccgccacatgcggcccggccattgaagttccgtcccagccgccttcgtatgttcctccaggaatagaagaacggatattcacgcccggagccgaaatgtccggttttgtttcatgatacggtgaggggccttgaagtgagaaatcagcgagtttcttgtcgatgtcagtcgcacctgtcgcaaatgcttcaggataattggccggatttgcgattgaacccggtcctcccggtgtaaataagtcttcatttcccgcagagaattccggaaaaatccctgccgctctccacgcattcaccatatcgcggtaccactcgtccattcccgaaccgcccgcccaggaattattgacaacatccggcgccatctcgggatgcggcgtgccgtttttatctttaggcgcaagcacccattcaccggcatccaaaatatcggcatcggttcctccgtcatctgaaaatgcttttactgcgatccatttcgcccccggagccacaccgatttgatttgagccgtcaggttctgaacccgtcatggtccctgttacatgagtgccgtgttcaagatcgtcgtagggagcgtctttatgggacacggcatcataccagttcatttcatgattcggcgctgctggattttcaggatcgtaaccccggtatttttccttaagcgcgggatgatcccactgaactcccgtatcaatggaggcgacaaccgtgccggttccgtcgtatcctgaggcccaggcctgcggcgcatcaatttggctgatattccattcgatgccttcctttgctttgacctctttttgttttttcttcatttgaaaaggagcttttgattgccgttgagtaagctgacgtttttcattcggaagaactttttctacttcaggaaatgaggcggctttttccattacctctttcgaagcagtaactgccattccgttgacaatataataggaatggatgtgatcagcctttcctttctttttttgtttttccaaatatgttttcagattctgctgcgcatcatgagctgccagttttaaagaagaaacaacggctgaccgcttttgatattcggtttttgctgcggaaagcgaatgagactcggcatttttttctgcttctttgaccgcttttttcgtattggctttctctttaaatttgataagaaacgtgactttatcatttttttcaaaacgcttcttgactgaatcggaaatcttatgctgaatgctcttagaggaagaaagatctttggtaaaagaaactgcccccggtgtgctgttcgctccgactgcccccggaaacaacagtgaactgacgacaatcgcgcttaaaacggagcctgtccatctgtttctcgtttttttcttcaatcgtatccccccttatttggtaacgccctataaaatgtgtatccctccttcataattggaatcgtttgtcatttcgatgctgtacgttaaatgtagacaatcttccatccagatattgtcacattctgtagaaagccgtatgaaacttaaaaacaatcaattcgtcataggtataaagcttcttttttcactgtatagatcatgggggataggaaggaagactgtgcacaaaaaagaaaaaggacaaaaccatgtggtcttgtccttttttacatcagccgcgtttgttgcggtttcttaaaaatgtaggaatgtcgagggcatcatccgccggttgtgatgtatggcggttcaccgtgttttgatgctgtgtttcttctcgtttcggctcacgtttcgcagcattttggctttgagacttcaatccttggtttaaagtcggacgctgcggttttgagtcatctttttcctgttcgataaaaccggtcgcaataacggtgacgacgatttcatcttttagattttcattgataactgaaccgaaaatcatattgacatcagggtcagatgcagaagcgacgatgtcggctgcttcctgcacttcgtagaggctcaggtttgtacctcccgtaatgttcatcaaaacaccttgcgctccgtcgattgccgcttccagtaacggactggagatcgcctttttggcggcttcagcagcacggctttctcctgtagcgatcccgatacccatcaatgctgaacctttgttggacatgatggttttgacatcggcaaagtccaagttgattaaaccaggcgttgcgatgaggtcagagataccttgcaccccttggcgaagcacgttatcagcttcacggaatgcttcaagcatcggtgtgtttttatcgacaatttcaagaatgcggtcattcggaataacgatcagtgtgtcaacggcttctttcattgccgtgataccgcctgcagcctgcagctggcgttttcttccttcaaatgtaaacggtcttgttacgacaccgacagtcaaagcgcctaagtcctttgcgatttgcgcgatcaccggtgcggctcccgttccggtaccgcctcccattccggctgtaacgaacaccatgtcagcgccttttaacgcttcttcgatttgttccttactttcttcagcggcttttttgccgacttcgggattcgctcccgctccgagaccgcgggtcagcttttccccgatctgcattttcacttccgcttttgacaggttaagagcttgcgcgtccgtgtttaccgcaatgtactctacaccctgcacttcattttcaatcattcggttgaccgcgttattaccgccgcctcctactccgattactttaattgatgctaagccgtctatgtttgtttcgaaatccaacatgctaaatcctcctaatctgccgaatgactatcaatctattcccaaaacatgcttaatagttttttcattttgctcggtttgttgtgttcggcttgtgttttttgttttgcttttggacgctgctgcgcctctggccgctgatgatgttcttcttcgtgagagaccgcgatttcctgcacggcttcttccggcatatgaaagcctatttttcttccctgaattctggcatttcggcaggcaaattgtatcaagccgacacccgtcatatactgagggtctcttacaccgatataattcgggcttgcgacccttacattgtgcctcagcacttcctgtgccaatgaaagcactccgggcattgcggcctgtccgccggtcagcacaaagccgccgggcagatctgtaattcccatatgctcaatttcggctgcggcaatctcaagaatctcttccactcttgcttcaataatattggcaatttcctgctgtgtaaaagattgcttttgattcgttcctatgacggtgacttcaaatacttcatcttctgaagcctcatcgtagaatgcatgtccgaattgtttttttactctttcagcctcttcggtggaagtgcgcaatccgatcgatacatctttcgtgatgttttcgcctccgagcggaatgacggctgtctccttcaggtgcccctgttcaaataccgccaccgtcgtcgagccgccgccgatatcaatcatggcgactccgaggtttttttcgtcttttgacaaagccgccgaaccggccgcaagcggctgcaggcagatatcagtaatttcaacgcccgctctctccacacagcgaagtaaattatgtaagatcgttttggagccggtaatcagcgtgccttctacttccaggcgcactccgagcatttttttcggatcggtaatttcgtctcttccgtcaacgataaactgtttcggaacgacgtcaacgatcagctgctcatgcggaaccgacacaacctgtgccgcttccattaccctgcggacgtcttcaacgtgaatttctttgttttcactggaaacagcgacaacgccgttcgtatcttgaatatgaatataatttccattaacgccgacaatggcttttttcagcggaaaacctaccattctttcagcttggtcaaacgcttttcttatagaatgaacggtttcatctatatcaacgattgagccttttttcaacccttcagacggtacatttcccactccgataatgttaagggaatcatctgtcatttctccgacgatcacttttgtattggacgtaccgatgtcaagactgacgtaaagttcattgttgttcattctatggcacctcctcacatttcgatcaaattctattctattatttgcggaacaacaatacaatgaatgtggctttacaagtgtgtaacaaaaacaacagcatcaacaaattcttatctgatttctcacaatttatgtttaatgaaactattcgttatattctatgtatatcctcttttatatcgcattttttttattttttttagagacggcccaccttaccgtaagatttcctgtcacggtgccataatgtgcaaaccagatgcaaatatacccgctttccattagtctacactaagatgaacctccagaaaagctatagatattgccagaaacatccgaaaaaagaagaaacaggaggaaaattccaaatgcaatgttcattgaagaagacacgcccattgcattgagaattttccccttgtccggcagccatatcccgggcaaaaacaaacatagtcataattattccgctatcggttatatcggctgccccgctgattgtaatagattcttttgaatcaccttaaaattagttctttagaactattaatcattttcttttttcttgccggatttacctttgttaaattcttcaaaatacgtagcgacttctaagtggataatcccctttttcccgccgtccagctgggaaacgatagaaggataggtcttcatccggtcggcaaatgttttaatagaagcggtaactacatacccgtcgttcatatacagcttgatccggtcctggtccatttttaccggtgtataatagatttcagaaatcgactgctttagcgaaccggaaagcttatcaagctgctccgccattttgacccgctttttcgcgtttgtccagtcaaccaaaatcgggcccgcgtcatccggcgtgacttcgttcggcagcacggtgccgttctccagcacttcataatacacatcattccgctgcagatacgcgatcgtcttgtattcttcaatgtgaatgctgactttattaggaaatacttttgaaagatccgcctttttcaccagtttattctgctcaatcttttcttctgtttttttcttgttcagactccagaactcggtttgtccgttatgtatatcagaaagcgcgttgatctcttttacagacacgttttcgttcccggaaacggtgacagaagacactttgctgatcggcatctgcaagtacacgatgatcagcaccatcataaaaaagagcacaatgaatgaaatcagccggcggtttgctttttgtttccgctgctctttgattttcggaatccgctcttcaatatttacgattttttctctttcatgatttgggttcactgcctgtccacctcactaagaatgaaacagcttgacattcgtctgattgaaaaacaaacggcatgctgtgatgccgtttgacatttgttaaaagtatatcacatgagctcatggaaatcagagaaccttttaacgattccctccgatgatttcaacttccgtatgcatgtcaacatcatactgctcacggattgtctttttcacatactcaatcaggtcgagaacgtccttggcagtcgctccgccggcattgacgataaaattcccgtgcatttcggatactttcgctccgccgatctgatgtccttttaatcccgctttttcaacgaggtttccggcatgattcggcagcggatttctgaatatgcttccggcgcatgggcttgaatacggctgcgtattttttctgtaatctttgttctgctgcatttgcgccgtaatggcttcccgttccttttgctcaagctgaagaactgcctcgagacagacgccggggcgttttttctgcaaaacagacgttctgtagctgaaatccatctcttcgtttgtcagccattcgattgtgccgtcttcaaataagatacgcgctttcacaagaatttcactcatatcagatccgtgcgccccggcattcatatagacggccccgccgattgatccggggatgcccgctgcaaattcgagaccggacattccttttttactcatggaagtcgcaagccggacgaccgaatagccgcctccgaccgtcacctgatcaccgtcaatctccaaatgatccagacccgcgcccagtttgatgacaactcctcttatgccttcatcaagcacgagcagatttgaaccccggccgataaccgtccatggcagatcatgtttcttcacaatatccataatatctttgaccgcttccacactgttggggatgatcaaaatgtccgccgggccgccgattttcatcgttgtatggttcgcgagcggttcttgttccagcactttgccgacttcgcggtctcttaattcctgaattacgttctccatcataaacctccgcattccatttgctctatttttttatgtcttccatgatactgtacagtctggctgccgcatccggaacaccgagtgattttgtccgctcactcatgtcttttaaggtttcttcattcatgacgattttgtccagcgcagcgatcagtttttctccgctgagctcggtttccttcagtacgattgcagcgtcatgctggctgagcgccttcgcattgacttcctggtgattggctgtcacatacgggctcggaataagcacgctcggaatgccgagagcggtgatctccgcaatcgtcgtcgctccggctcttgccacaatgacatcaattgattgtaagtactccggcatttggtgcaaaaacggttttgtcaccatattatcagcggcttttccgcctttcagctcagccgttaccttctcgtaatgcacttccccggtaatataaagcacttggtaaggtctcgttttcaattcttcctgcatatctatcacggcacggttaatgggagccgcgcctctgcttccgccgaaaatgagcaccgttttttgattgtctttcagcccgaactcagttaatgagcggcctgtcttaattgagacgacttcagaggctctcgggtttcccgtaaacacaactttttcagcaggaaaatgcgattttgcttcttcaaagcaaattgccaccttattaacatatttcgagagaaacttatttgtgatgccgggcaggctgttttgctcatgaatgatcgtcggaattcccatttttgccgccgcgtatacgaccggaccgcatacatagccgcctgtaccgataacggcatccggtttaaactcttttaaatatgatttgcttttcttcacgccttttaagaaacgcatgacggtttttacattttcaaaagaaagttttcgtttgaaacctgtaatttcaatggcgcggaacgggatattttcccgttcaacaatttttttctccagaccgttctctgttccgatatacaaaaattccacatccggatgccggcgctgaacttctttaataaaggccagggccggataaatatgtcctccggttccgcctccgcttactgcaatacgcattcgtatgtcccccttaatcacatagcgataaccctgttttttaggacagggttattgatgttgtctgtttttttatagataacgaatagatcatgagtgatgaggcaagatacagatcaatacctcgagtaccggctgacatttaaaagcacgccgaccgctgcgagcatcagcgtcagtgatgagcctccgtagcttaaaaacggcagcgtaattcctgttaccgggatcagccccgtcacaacgccgatattaatcatgacttgaatagctatcatagaaataataccgatggcgacaaagcttccgtataaatccggcgcgccgagggcaatcctgacgccccgccacaataaaatactgaacagcagcaatatgagcgaaccgccgataaagccgagttcctcagataaaatagcaaaaatgaaatcggtttgcggctccggcaggtaaaaaaacttttgccggctttggccgagccccatcccgaacagtccccccggacctacggcatagagcgactgaatgatctgaaatccgcttccaagcgggtcctcccacgggtttaagtaagaggtaatccgtttaatccgataaggagcggacagaacaagcgccgcaaatccgcttaaaccgatgagtccgaggaacgcaaaatgagcgattcgcgcaccggatacaaaaatcatcacgatgcacgtgcccaccattaccgtccccgttcccaggtccggctggcacataataataataaatgcagaaaacacgattccgagcgcgggaacgaatccgcgtctgaatgacgtaatattcttctgtttttcagaaagaaatttagccagaaacgcaatcatcgcgagtttcataaactccgaaggctgaatgctgaacgctcccactccgatccagcttcttgaaccgttccgcaccattccgactcccggaatcagcacaagcacaagcagaaaaaaacaaatgatcagaagcagcttcgaccatgtgcgccatgtccaataatccacattcataatgaaaaacatggcaatgacgccgatccccgcaaacagcagctgccgtttcgcgaagaaaaacgagtcgtcaaatttataatccgcccataccgcacttgcactgtagaccataattaatcctattgttaaaagcaataacgtaatgataactaataacaaatcaggcgctgtttttttagtagtcaaagcaatcgacaccccaagcataagtcatttagggctgccgatgaacagagacaagcccttacttaagcatatgcacggcatctataaacatgtcaccgcgttcttcaaatgttttgaactgatcccagcttgcacacgcgggtgacaagaggatgacgtctccttcatttgagagcgcaaacgccgcagatactgcttgttcaacattatcgacacgtttgacatgttgtattcccagctcattgcccagtttttctatcttcggcgctgtctgtccgaacgtcaggaccgctttgacattgtccatatacggtttcagatcgtcaaaaccgttgccgcggtccagtccgcctgcaagcagaataaccggtgctttgaacgcggagagcgctttgcttgtggccaaaatattcgtcgctttgctgtcattataaaatttacgattccggattgctgttacatactgcagacggtgtttgacaccggtaaagcttgtcagcaccttctgaatcgctttattagacgcgcccgccgtttttgccgcggctacagcggccaatatattttctaaattgtgcgcgcccggcagcacgatgtcatcaacaggcagaatcgcttcatcgccgaacatcagcattccgtctttaataaatgcgccgcttgacagttcctggtgcactgaaaacggaacggtgccggcttttccgctttcggcaagccgcacgactgtttcatcgctttgattcacgatggccgtatcactctcaagctgatgaagatacacgttctgcttggctttttcatagttttcacggctgtgatggtaatccaaatgagcgtcgaacacatttaaaatcaggccgatttcaggtctgaacgcatgagtccccataagctggaacgaagaaagctctgtgacgatccattcatcaccgtcagcatgataagccacttcactggcgacagtgccgatatttcctgcgatcagcgcctttatcgagtcagctttcagcatttcataaatcagggtcgtcgttgttgttttcccgtttgaacctgtaatgccgatgaattttgcattggtgatataatacgcaagctcgatttccgtccaaaccgggatgcctcttctttgcgcttcctccaccatgatattttcatacgggattccgggatttttgatcagaatggtaatgtgatgctgatcaaaaagtgacgtcggatgctcaccgcagatgacctcgattcctctttctgaaagcctttgggcaggttcgttctcttcaaaggctttttgatcattcacgacgacgttaatgcctttttcatgaagaatcgacgcagccgcatatccgcttttcgccagtccgaggaccagaaagttttgttttcgcaaaaaaagttcgttttccacttataaccacacctcgatgtaaattcctaaaacggcaagcagcagtcccgcagtccagaatgtgacgacaactctccattcagaccatccgaccaattcgtaatggtggtgaagcggactcatcttaaagattcgttttcctgtcgttttaaagctgatgacttgtaagataacagataaggtctcaataacaaaaactccgccgataatgacgagcagaatttcaagcttcgtcagaatggcaacggtcacgatcgctcctccgagcgcaagcgaaccggtatcccccataaatactttggcgggatgggcgttgaatacaagaaaaccgagaacggcgccgacaacggcaaccgagaaaatcgcaacgtcatattgtgactggttccacgcaaggatggcgaaagcgccgaatgcgatagccgcggtaccggacaagagaccgtccagaccgtctgtcaggttgacggcatttgaacctccgacaagcataaagagaacgaggataaagtatccccagccgagatcgattgacagatgtgtgcccggcaccctgatgccggttgaaaaatggcaataatgatatactccgtaaaatacaatggcaataatgatctggccgatcaatttctgcttcgacgtcaatccgagattccgtttcattactactttaatatagtcatccagaaagccgagcaggccgtatccgatcgtaacaaacagcagaagaaacatttccgcgctcagatgcgaaaatttctgcgtcatgacaatcgccgtaatagcgatggatacgataatcatgaccccgcccatcgtcggcgtccctgattttttcatatgtgatttcggcccctcttccctgatactttggccgaattttaaacgtcttaaaaacgggataagaatcggagatatcagaacactgattaaaaatcccattattattgtaaataaaatcacttgctcaagcattgctcttttctcctcccgtttcgttcaaacgacatacgtatttatcatattcacattgtgtccccgtaattcttttcatttcactcattctaacactctttcctgttttactttttattcagctcaacaatagctcttcccgctacttcggcgtcatcaaagtcgaatgtttcattgccgatctgctgataggtttcatgccctttcccggcaatcagaaccacatctccctttttcgcgttggcaatagcaaaaaagatagcctgctcgcggtttgcgatactgtgatagtaggtgccttctacccctctttccatatctcttaatatggccagcgggtcctcgcttctcgggttatctgaagtgaaaatcggttcgtcggcaatccgcaccgcaatttccgccattttcgggcgtttcgttttatcccggtctccgccgcagccgacgacgacgaaaagcttgccctctgtcatgtctttgcatgtattcagaacgttttccagactgtcaggcgtgtgcgcgtaatcgacgaccacaggaaacggctgattatgattcaccagttcaaaccggcctctgacaccttgcagctcttcaagagcgctcgtgatcgtatcaaacggcagacccgctgcgatcgctgtcgccgctgcagccagtacgttatacacgttgaagcggccgacgagtgaaaccgtgatctgctttgttccttttggcgtaacgagttcaaaatttgtgccttgcgcagagatctcgatttgtttcgccatgacatcggcatcgttctcgattccgtatgtaaggatgtgcgccgccgtcactttttcaaaataagcactggctttgtcatctgcgtttaaaacggcccgcttcggcttttcatggttaaaggagccgcccagctgggaaaacaggaggcttttagcctgtctgtagtcttccatcgtcttgtgatagtctaaatggtcctgcgtcaggttcgtgaatacggcgatatcataatcgcagccgtgaaccctgccgagtgacagagcgtgagaagacacttccataatagctgtgtcaacatgctcatcattcattttcttgaacgttttttgcagtgtgacgctttcgggcgttgtatttttgaccgggaatgtctcatccccgattttaatgtacatcgttccgattaaaccggtctgtcttcccgcttttttgaaaatctcatcaaccatgtgcgtcgttgatgttttgccgtttgtgccggtgatgccgataagctgaagctgctttgtcggctgcccgtaaaacgcgtcagaaagaacgctgagcgcccgctgtgaccggcggacgataatgacaggaacatcgacgtcaagctctttctcggcaacgatggccgctgcgccgttttctgcggctttttgggcgaaatcatgtccgtctaccgtatacccttttatacacacaaaaagactcccttttctcacttccctggagtccatctcaattgaagttatgtcagggtcatgaaagtcattttgaacaggttcggccattaaatatgtaagcagctttgtaagtttcattgtatcaaacctctcagaaattctattcattcttttatcatgataaccgtttataaaagtcagaatggcttttaaacatacagttcatattttagcgtaaataaaaggatacatccagttaatcttaaaagttatcttctttttttctctttatgataaaaggcagccgaaaacaatcggctgcctcaaaaagactcattcttcactcaagtaaacacggatctttgagccttcttttactttcgttccggctgcaggtgattgtttcacaattttgcttccttttcctgaggagtcaatattcaaattgacaagcagcgactcaagatcagagacagacatccctacaacattcggaacctctattgtttttgtgtcgttccattgatattttttctcgatttgattttttcgcggtttcacgccgagctccggcagactgtctctcatcatatttccgacaatcggcgcggcgacggttcccccgaattgaatcgtgcctttcggattatcaaccgcgacatacacgacgaggctcgggtcatcagccggcgcaaaaccgataaaggagacgatatggttgttttcgagatatttgccgtctttgaccttttgtgcggtacctgtttttccgccgacgcgatatccttccacgaaggcattccgccccgttccctgagcgacgacgctttctaaagcatatctgatctgctttgacgtttcctgggaaataacttgccttttcgcaatcggcgattgtttcttaactgtttttttcgtaacgggatcaacccactctttggcgataaacggagtataaagcgttccgccgtttattgctgcggaaacggctgccacctgctgaatcggcgtgacggaaaccccttgtccgaaagcggttgtcgcctgttcgaccgggccgactctgtcaagcgggaataaaatccccgttccttccccttgcagatcaatgcctgttttctttccaaagccgaagtccttaatatattgaaacagcttttgttttccgagccgttcccccagctgtacaaacccggggttgcaggaattttgaacgacttcaagataagattgcgaaccgtgaccgccctttttccagcatcggaggcgggcgccgtcaacctcggcaaatcctttgtcataaaagtggtctctttgcaagtttactttttgctcttggagagccgccgcaagcgtaataatcttaaaggtcgaacccggttcatatgtgctccataccggcaggttccggttgtaaacggacggatctacggattgatagtcagccggatcaaaatcaggacggcttgacataccgagcacttccccgtttttcggattcattgcgaccgcaatcattccgtccggattatatttcgccgctgcattatcgagctctctttctataatcgtctgaaccttggcgtcaatcgtcaatttcatatcaagtccgtctttcggaggggtgtaatcatccgcttcatcaggcattttcttccccttggcatccgtataaaatttcactgatccctttacaccttttaagtcatcatcataataagcctccaatccgagaaggccctggttatcaatacccgcaaaaccgagaacatgggacaaaaagcttccgtacggataatggcggatgctgtcttcagccacataaaccccttttaagtcgagcgctttgatttctttcgcttttttattggaaattttccgcccctcgggtgagattttttctatggaggttttcttagtaatgtgtttgtagaccttctcttccgacatatttaaaactgacgcgagaagcttgcccgtttttatgggattttgaatctggcgcggtacgacaaagacggtcggcgcgcttttattcgtagccagcttcacgccgtttcggtcaaggatttctccccgctcaggctcaaacggcaaattccggctccaggaatccttagccagtgaagtcagcttttctcccatcacaaattggacatagcctaatctgctgtcaatgatcaaaaaaatgattacgccaaaaagcaaaaccagtaataaacgttttcgaaccgttacatttgaaacgcgcaagggaccgtccactccttatttaggcttgtttcaatttatgcctcagcttggacacatagaacggcggcgcataaaaaagaagcccgcgggcatccgcggacttctctgtcccgttaatcaggatttttaaatttcaccttgatcacggtattttctttcagttctttgccttttttcacactttggcttgaagcgtaaccttcaccgctcacatcgatgtgaatgcctgatactttgctgaattgaagcacttcccgtctcgaccatccggacatatccggcatcgtcatctttccgtctgtttttaagaagattttctgattggtgatcacatcttctccggctgtcggatactgctcttttacggcaacatcgctgccgatgacaatcggtgtgagatgttcatttttcgcttccttctcagcgcccgtgactgtcttatctgtcaggtcaggcatcttttggcttttcgtttcttcctgaccggaatctgttttttccgtcggttcgatattcatgtagtggaggctgtttttcatcgtcgggttaaagatttccgcgacaggatcagagctgctttgacccgcttttaactgcggctgctgcacggctacatagatgacgagcttaggatcatttttcggcgccatgcccatgaatgaaaacacatagttgctcgttccccttaaatatccgcctgtcccggcgatttgtgcggttcccgttttacccgcgacgtcaaaaccttcaattttataaggttttcccgttccgatgtctgacgtcacgacttctccgagcaggttccggacttttttcgccgtatcggctgaaatcggcgtgccaacttgctccggttttgtctgcttgacgacttttttcgtatcggggtcgacaatatgatcaatgacgtaaggtttcatcattttgccgttattggcaatcgccgtgacggcctgaagctgctggatcggtgttatcgccgatgcttggccgtaagccgtagacgctttgtcaaaatcatatttgtagttaattttacttgatacttcaccgggcagatcaatccctgttttttgatagagcccgaatttgtgcaggtactcattaaaccggtcaaaccccagtttttcgttggccagtttggcgaaagcaacattcgatgacctcatgaggccgtcatggaagcttgtcataccccatccggcgccatcgttccaatctttaacaggtttgcctcccactttatatgttcctgatttatatttctcgtttgcggaaaacacattttcctgaatcgccgcggcaagcgtaaagatcttcatcgttgaacccggttcatacgcgtacgacactaagtcgttgtaataattggtgacgtttctgatattcgggtcaaaactcggacgctgccccatcgcaagcactttgcctgttttcggttctacgacagccgccataatttttttcggtttatatttttccgctactttcgtcatgctgtcttctagaaaggtttgaattttctgatcaatggttaaatatacattgtcaccgtttttaggtgcggtgattttttctttgctgttcggaagtttccagccggatttatcactttcgtaagtgacggacccgtcacgttccgtcagatagttattcagtattttttcaagtcctaaagagccttgtatctcgtttgttttttcattcacatcggcatagccgagaacatttgacaaaaatatgccgttcggatagtagcgcttcgtatctcttaagaaagaaatacccggaagatccattttttcgatcttttgttttttcgcataagagatatcgcggccggctgaaccgaattccacctgcttcgcgccattcctgtttaagatgtccagaatctcgcttttatcaagattgataacggtcgccagtttttccgccgttttctctttgtctttgacatgctgaggatgcttcggatcactcgtcatttttttatcaagcacggcaatgagcttatatgtcgccgtgtcctctgcaagcactttgccgttccggtcaagaatagagccgcggctcgcttctatcgtccgctttttttcgtgctgctcggtcgcttttgttgcaagttctactccgtttgctttaccggttaattgaatgtacgccattctcccgagaatgacaaagaaaaagagagcgaaacaaatactgagtatcgctgctcctctgttcataaacttattttttttcggcatgggttatcattcctgtatgtttttcacttttttatctttcagattcaaaccgtgctttttagcgatatccatcaggcgctgcggctggcttaagtcagcagccgtcttttcgagatcaccgatctgcttattcttctcagatactttctcctccagtttttgcacctcaatattggattggtacgccgcgtatgcctttgatacgataaacattgatgtggagagaacggcaatggcaaacaggacgagcagcaccttttccccgagtgtaatggaagccctctttttgacaatcacctttttttcgggacttatcactggccgttgttgtttttcctgctggtaagctaagttgctcataggctgatgacctcctttaatgttgtcatttgctgcccgttattttcgtttctccgcaatgcggagcttcgctgaccgggcgcggttattttcttcaagctcctcttttgatgccgtaatgggctttctcgtaatcagttttaattccggttcaaattcttccggtatcacgggaagacccggaggcagttcgggaagtgatgatttttccttgaatgtcgtcttgcacattctgtcttccagcgagtgaaaagtgatcacagacacccttccgcccggcttcagcacctctatcgcttgcaagagggcctcttcaaatacctgaagctcgtcgtttacggcaattcgaatggcttggaatacacgtttggccggatgacctccgcttcttctcgccggagccggtatcgcgtcctttattagatcgaccagttggccggttgtttgaataggcgatttttctcttgcctcttcaattttccgggcgatctgcttgctgaatttttcttctccgtatttaaagaaaatcctcacaaggtcctcataccgccattcatttacgacttctttcgccgtaagggcggccgactggtccatcctcatgtccagcggtgcgtcatgatgataactgaatccccgttccggtgtatcaagctgcggagaggatactcctaaatcaaataaaattccgtcgacactcgtaatgccgtgttcatgtaaacactcttttaaataacgaaagttgctttttaccagaatgagctgtcctttgtattcggacaatgttttctgtgcgttttcaagcgccgtgtcatcttggtcaaaggcgatcaggcgtcctttttccgataattgctgcaataaatatgtactgtgcccggcgccgccaagggtgcagtccacataggttccgtccggtttgatatttaaaccgtcgacggtttcacgaagaagtactgtcttatgctgaaacatttgtgtcggtcccacctttatcaggaatgaattgaattgtcagttgttgttgtgatgcacgaagatccattatatatcaaatccaatcatgttttcagcaatttcagcgaatgaatcttcttgctcttctgtgtattgttcccatattaccttactccacaattcaattcgattggaaaccccgatgacaacacattctttttccagttttgcgtaattcagaagagatgacgcaatattaacccttccctgcttgtccagttcgcattcggtcgcaccggaaaaaaagaatcgggtaaatgcgcgggcgtcttttttggtgagcggcagagccttcagcttttcttcaatcagcttccattcattcatcggatagccgaaaaggcattggtcaagtcctcttgtcagcacaaactgctcaccgaggccttctctgaattttgcgggtacgatcatgcggccctttgcatcaattgtatgctggtattcacccataaacatgataaggacccccactttctcccctaaactcaccactatccgccacttctctccacaacctcattttacactgtttacacataaaaaaaaaccctgaactattcagggttctttaaaactttatttcaaagtttgacaatctgatgttggttttgaaaagaaaatggcagatgtttgaaggttgtgaagaattttggaccataacggttcaaataatacattacattccaaatccgttcctgcggagcgccgagcggtctgatgctgttttggattctttcatagtcacgcagcacaaaaccttctttttcttcaattcttttcgttaccgtccgttctaaaaacaagagctgatcctgaatgaaggcggcattcttctgtaagagcggctcaaggcttgaatcgaccttcagcgcttcgttccttgcgcttttatggacagcttcaatctgcgacttcgcctgttccattacagaagaaaactcttccggaatctgctcttcaaaataagcgtctttcaggtgtccggtgccgtgttcgatcgcttcctgaagcggaatattccgttctgaaagcttcttttcaatatggcgctcaagaatcgtaatgttcagtctcggcactaccggcgtcatgcggaagcccattaatgagaaagcctgcttcagctcaccccaataattgatctcccccggtcccgcgataaacgccagagtcgggatgagaaactcctgcataagcggccttgtcacaacgttattgctgaaacattccggtttttcttccatatgggtatgaagctcgtcgttcgtccacttcaggtcaagctccttaatgacaaaaacgccgttttctttttcaattaagaaacgctctccctcgtgttcgtaaaacagattagcctgatctttgtccgattcaataatcgggtgataaccggcttcccgcataagacgctgctggtctgacacggctttgacaagctcgtgattgtgttttaaaatctgctgaaacatacccgtttccagctttttaatccccggatctcccgaattcatcagaataaggccttcttcttgaaacaagtcggcgatcaacagctcaaaaaagtccgtgaatgtctctgatgagcgtaaacatcgcttcacgttttgaaggagtgtgtttgtgtgatccgtttcctcaaaagcagcgaacacttcatcaatccaagccgcgcatttttcctgatcaagctcggttttagccgccgatgtttttttccagtacgactgcggcagtttccgcttcaccggacctttattctctgttgacgtatgcacataattaatttcttccagatcgtgatcttcacccgccacccagaaaatcggagcgacaggaatctgcagcgcctcttcctgctgtctggcaagtacgataatggagataattttatgtatggtgtaaagaggccccgttaaaagaccggcctgctggccgcctacaaccgctgcgctttttggatctctcagtttttcgatggaggcctgcatggcggcggagtgaaatttttcgtgataggaggataaataatccgctaattcctctctggcaaacggccgcgaagagaggtcatgaagccgcttttgccatacgtcctctgaatgaatatcataatcaaaaaatgaagacatgttttctccatctatatagtgctgcacaaacttattttgacttttgatggaaagttcagttagctgcatctgtctggaacttcctttctccaataaatagttaggtttccgaaatgagtatagcatgttaccggaaaacctcaaaagactttgtttcaatttctttctaacgcttttatgctgcggtgtaaaaacgtgagatgaacggccggcaatccgcggctttccgcttcttttacaaggtagccgataatcgcatcggcctcggtccgcctgcctgccatgatatcgacgagcatggaagaatgatttttttccgtcagtctgcaaacttcgcaaaccttgttccacgctttttctctatcggcgaggccaagtattgtctccgcttcttcaaacacgtttctcatatattttttgtaagcgtcatttcttaacagctctccgtttttcacgcgcagcaatgcagttaacgggttgatgcatacattgatgatcagttttcccgttaaaagccgataccagtcgttttcatcatatacgggaaaatcccggtgcatgccggaaaagatgcttttgagcgtttccggccgggatgcgctgaatacactccatcttacggctcccgctcccgtatgttcaacggcatgatccgatatcttttttgctccgtgctcaactgtgccggcataaagcgaatgatccgtatgccaatctctaatgtcgtgtatgtgtcccatgccgttttgcaaaaacagcacattcgtcccttttaccgtctcaagatcccgcagcacagcactgagctggtgctgtttaacggctgcgattaagaggtcgaatccggaagtgatgcctgtttgcgctctgcatgccgccgtacattctattccgtctttcaaaagccgtataccgcctgagttaatcgcatcagcctgctccgtccgccgcgtaatgactgttacctgatggcgggacgataagtagtaagcacataaaaggcctaccgctccgccgccgataattccgattttcacactgtcacaccctatatctgcatttttccatattatcatagcagaagccgccgcaaattacttcaatttcgttttgagcaaaaagacaggcaagcatattatagttggaattttcaattaaagcgtttacaataatggtagaacacaacaaagggggagtttgtgttgaaaatagagcgcctgctcatcaactttaagacactcgaagaatttaaaaggtttaaggaatacgggatgcaggagctgtcgatgcttgaagatcttcaggataatatcattgaaaatgacagcacctcgcctttttacgggatttacttcggggataaactagtggcgagaatgagtttatatcaggtaaacggaggcgcgaatccgtattttgatcagcgtcaggactttttggaactttggaagcttgaggttcttccgggctatcaaaacaacggatacggaaaagcgcttgttgattttgcaaaatccttcagaatgccgatcaggacaaattcacgcatgaaatcagcagaattctgggataagatgaattttgagcccgttaaatatgatatggcgcgtgataaaggagaaaatccttacatctggcatcccgatatggacggtgaaatgacatccggagaaacggcataataaaaaaccggccgggccgccgccctcaggccggttcattttacaggctctgcgccgatttcctgtcgtcttcttttgaattgaccatccttctcgctctgtccataatgtcaattaacgctttataatcttcttccgtcatctccagcttgtttctcaagctttcattttcctcacgcagatcctcgacttctttttgcagcgcggtcagctgttctgtgagtttttctttttcatgacgcacatccgctgcggccggcgactctttaaattgctgaagaaacaaaatgacatcatcaatggacagctctttttctccttccgccctgcggatcggaggctgtttgacggttcccggcagattggcggaatgcaccccgatctgctttcttaattccttccgctgttttttcgccagttctatccctgactgatattgttttctgacataagaattccatctgaacccgcaggcggcagccgttctcgtcagcgctctgccgacttcttcaaaagcggaaagctgggtcccgccttcccgaatatgcctgagcaccacttcggccagcagcaaatcttcatcttgcgtccacgcgtcttgtctcgttatcgtcaatcgtatctccctccatatttgctcatttacctcatacatatgccgctgatagattagatagactactggcgctcacaattttttcggcggaagcaggccggaggggcaaaaaaaaagaaaagcgcaggaaccgagattcccgcgcttttcttcatacattaattgcttttaacatttatgtctttgccgttgtatgatccgcatgctttacatacacggtgagacaatttcatctctccgcatgacgggcattctgtcataccaggtacatttagtttgaaatgtgtacggcgcaatctttttttcattttagaagttcttctaaaaggtacagccattattcccacctccttaaagagttaagattcatcatcttgtgttaagagctttttcagatccgcaagtctggggtcgatttgatttttcttgtcttcctcagaaatcacttgccaatccttccccacttggggagcggctccttctttttgttcagtttcacaaaagacttgcataggaatttctaaaagaatctcttcttttacgatcggagttaagtcgacgatatcgtcttcagcaatatgaacgtcctcatcttctatatcatccgacttatgaaatctaaacagttcttttgtcgcgattgtaaatggatacggcacatcaactaaagttcttgagcacggcaaaaccatttcgcctgaaatcgtaaagtcaaacgaaacttgcttggattcaatctccgcgcggcccttcacccggacgggagaaatgcggcggatgtcagaattcaattttgtcagctcatttaactcaactgtttcatcaaattcaaagctctttttcgccatttgatgaagctgataaatcgtccatttcatttgtatcacctcaggaaagcaacaaacatgattatagcttttcagaatgtttttgtcaatattttttctttacagcataatgccgccgtcatgcaatcgttgacagccggataggctatgcatacactaaacgaaacggactaaaatatgcacttcatttgcaaatgtaccacacgaagcaaaacatagcaagaaaggcgggacaaatatgaaagcagtcggcctggttgttgaatataatccctttcataacggacaccgctatcatgcggaacaagcaaaaatcaaaacggacagcagcgtcgcggcggcggtgatgagcggcccttttttgcagcgcggagaaccggccgccgtctcaaagtgggcccggacaaaaatggcgctggaaaacggcgtggatatcgtcattgagctcccttatatgtatgccgtacaaaaagcggaattattcgcgcgcggcagcgtttcgcttcttcatcatttaggatgcagcagcttgtttttcggcagcgaaaacgggcggatcgaaccctttattgaagcgtctgaagcgttcagccgaaaggaagatgactgcagcctgattctgaaagaggagctgaaaaagggtctcagctatccggccgccgcctcaaaagctttttcacacatattcaaagggcgggacatgctcgatttgtccaagccgaacaatattctcggttttcactacgttagagcgatacacgccttcggttccgctatgaagccttatacgacagccagaatcgcttcccagtatcatgacgccgagcttcccggagataacagccggatagccagcgcaacaagcatccggaaagcgctgatagaaaaaggaacggcggccgcaaggagctttctcccggaagcgtctgcgcgtgagctggaggcatacagaaattcatacgggatatggcacagcaccgaagactatttttcatatgtaaaatacagcctcagcactctgtccgctgaagaattgagccgaatctatgaagtggaagaaggccttgagcacagaattctgcgcaccatcagacaagcccgatcctatcgcgaaatgatggaacgattgaaaacaaaacgatacacgtggacgaggctgcagcggatgaacacgcacattctgacacggacgaaaaaggaggacatgcatcggctcttacagccttcaagcgctccttatatccgtcttctcggaatgacgaaaaaaggacaggcgtacctgtcggcaaagaaaaaagagcttaccgcacctctcgtcagcaagctctcttctttctctcatcccgctctggatctggacatactggcgggacgggtttacagcctgccgataaaagaacctgaacgcacattttttgagaaacaggaattttcacaagcgccgatccgctatgatgaagacgaacagcgttttttgaatgcgtaaaaaaagcacctgcctgtatcaggtgctttttactttcagatgatccaaatagtcaagtgcgtcctgcatggtgtcgacagggacgatcttcatatcggacttgattgctttcgccgtttttaccgcatttttgtaatcagaattttcagctccgttttgattcggcgcaaagaaaatatcttttcccgctttgtctgcggcgacgactttctgatcgattccgccgatcggtccgaccttgccgtccacgtcgattgtccccgttccggctatattatagccttttgtttcgtcaggttttgtcagctggttgtaaatttctaaagacatcatgagacccgcagaaggcccgccgatattttcaatgctgaaatggagatccggctttactttcacgttccgatccgtatataacgcgacgccgattcccgctcttttcgggtcgtccgggaatgatttcagcgcaatgtcaacggtcttttctttcgtgtcccgttcaatgtgaaacgttactttctcccccgcttttttgctgctgatataatcaatcagcttttcagcggattcgtatgttttcccgtccgcgctgatgattttatcaccgacctctatttttccttttgccggcatgtcagagacgactgagctggcgaaaatcccgttaaatgagtatttcacctgtttcccggctttttgataagcggcaatgaccgcgttttcttgggagcttttcatcatttgcagctggcgcttcatataatccgagtccgattcgccctcttcttttatgctttcatcagggacgatttcatcgtaaggatgcactttcgcccaaagatatgtatacggattggcggggcctactttgacagtcatcaaggaaaggcttcctttttcaggatagcctccgtccaccttaatcagcggtctcagctctgatgcttctcccggctgtgtaatgtaatacggaagcttaataaatgtaacagcaattaataagatcaggatgataaacacccagcgaaaatgttttgctttcatatgagttagccctcccagttctctatttcttgtttaatccggccgatcatccggtctgcggcttcttcgcccgctgtgatcatatgatcaatgttggcaaaagaacttgagctgaatgattcaagagaagggcggatcatgacgtctgcggcaatggtctggtgacggaccaattcattttgcagtatatccatactttgcatgattacatcaaaaatatgtgccgctttttccgtttttttcacccgggatacgtcagaggcgatgacgatatcagcacccatgtcttttacggcggacaccggtattctgtcgaccaccgcgccgtcgactaacatacgtccgttcattttttgcgggacgaaaacgcccggtatgctgatgctcgcgcggacggcttcggatactgaacctttcgtaaaaacgagtttttcgccggtctgaaggtcgcaggccacgatgccgagcgggatccgcagttcttctatcggcttgccgtacgtataggcatgaacgagctgcctgatgcggtctccttttaaaaatccgagcctcggcatcgtataatccgcatacagccgccgcttaaatgctttggcgacttttttcatcgtagccacgtcatgcccggccgcataaaagctcccgactaatgctcccatgctgctgccggcaatcatatcaattggaatctgatgcttatgtaaactggataacactccgagatgagcgatgcctcttgcccctcccgaacctaacgctaacccgattgtaggtttggccaacgcgacgaaccccctaatagacatcctatacatgaattctatggtctaaattgaacccctatgctcgtatattagtacaggatgacaaataggtacttgcccggccgcctttaaggtctgttctatattttatcatgatataaatgtcagtgtgcaattttagcatcggggaggtaagaatgaatttgtctaagtttcatacatttttgatttcattgtttttcatttttttgacggcgacggttatttcacaccctcaggcctcattcgaagcctccaaaaccggtctttccatgtggtgggaggtcgtttttccttcattgcttccgttttttattctatctgagcttttaatcggattcggcattgtcaaatttgtcggccttttactcgaaccctttatgcgtcccattttcagagtgccgggggtcggcggatttgtactggctatgggcatggcttcaggcaatccggccggcgcgaagctgactgcacggctgcgccaggataaacaaatctccagagtagaggctgaacgcctcgtctcttttaccaattcatccaatccgttatttatattcgctgccgtggcggtcggcttttttcataacgcgtctctcggcattctgctggcatcggctcactatcttggaaacatcgccgtcggcctgacgatgcgttcatacggacggaaagaagaagcggcgtataccggtaaaaagacgatcgctctcccttctctgaaggaagcatttctggccctccacaaggcgcggctttcggaaaagcggccgctcggaaaaattttgggcgacgccgtcacctcttctgtacaaaccttgctgatggtgggcggttttattatattgttttcggttttcagccggttattatcaatcgtacaagtcatggatgtgctttctgtatttacaaacgcgctgctttccctttttcatcttccggcaaatctggacatccctcttatcagcggaatgtttgaaattacacttgggagcaagctggtcagtgaagctgatgccgccttgctgccgaaagccatgattgtgagttttattctcgggttcagcggcctttccgtacaggcccaggtagccggcattttatcggaaacagatatccgctttaaaccgtttttcgcggcgcgtatccttcagggcatttatgccgcactctttattctcttactgtggaagccgctttaccttgcattggacgaaccttaccagtccgtattcctccctttccgcgatcaggacgcgggatctgctgccgtcagcggatggaatacacttgttgaaaccgggcccgccatcacgctgacagctctcgccgtatacgcattgatttattgttacaggctgtcagcacggacaaaaaaaggatgagacgccgatcagcgcttctcatcctttaaatttctgcttcagcgcctgttcaacttccggaggaacaaactctgaaacaggcccgttatattttgcgacttcttttacgatgcttgaacttaaaaaagagtactgattgttcgtcatcataaaaaaagtttctattgattcgtcaagcacgcggttgacggaagtcccctgcatctcatattcgaagtcagaaacagctctgagccccctgataatcgccttcgcccgcttttttttcgcatagtcgattaacagtccctgtgacgtctcgaccgtaatattcggaatgtcttttgtcacttctcttaacagctcacagcgttcctcgactgtaaacagcggctgcttagaagaattattgagcacgcatacgtacacctgctcaaacacgtttgccccccgtctgataatgtccaggtgtccgtaggtgacgggatcaaaacttccgggacatacagctatacttgccacatcattaccccctatttcggtatatcgtcactcctgtaagcccgtaaatttcccttcttgttacagaaagcgcgccgacggcttcaggaagcacaacggctttatcatgctcggctacgacaaaaccgtcttcattcagcatgttctgctcatcaatcatttcgataagcgctttcagcttttgttccttatacggaggatctaagaaaattccgtcaaaacctttttcccgtttcgccgcggcatagagggcccgctctgcatcattgcggtatacttccgatgaagacagcagatcgagcgctttgatattcgcttttaccgtttggatggctttgaaatcacgatccacaaagatacagcggtcaaatccgcgcgacagcgcttcaatcccgaggccgccgctccccgcaaacaaatccagccctgttcctccgtcaaaatacgggccgatcatattaaaaatagactcttttactttatccgtcgtcggccttgttgatgtgcccggcaccgcctttaaggctcgtccttttcttgaaccggaaattactctcattattcacaccactttttctgaaaactttgatgtttctcatcggctgagccgttatgtataaaaacaatccctatcttatcataaagcattctttcaaacaatgaacgtgaaaaacgtgtatacatattcacattcctgtcaagactacgtgtaacagcatcaatgaatgatgttgttgccaaccgcggagaagacttacgtttccccataagttcttcctccggtttctcctctcccttttccttctccttaacttgttaaggaatagaaggaccccgcaggtatctgcggggatttttttatataccgactttataatcgtactctttcgctttatcaagctttgattcaaattccagctttaaaaaaggtttataagaaggctctaccttcttcacataagaataagaagaaatcttttccattgttttttcgatcaggtccatatcgcaatacagcacaacgtatttcagccgcttggaaacataatgaacgttgccgaattttctcagcattttgctgtgttttaaagaatgcagatatacgattatgccttggcgcttattttccatcatgatcacccgcctgactttctgttcattttatgtaaaagacgagacggccgtctcgtcaggaaactttgcatccgcagccgccgccggaaccgcagccgccgccgcaggatgacaggccgtcaaaataaggattccccgtcggcacttttacatgctccgagacggccgttccgagttcaatgctgatctcgtcaagcagcgactgaagctcagtctccgcttttttaaattcggccaccttatcgtttaaatcgagctcccgcttcatttctctcattttgcgggaaatctctctataatcaggatggtatttgccaaagcgctgcacatcctcatactgctctttaacgctcataaaagaacgaatgatccgccctgcctcttcatcttcacggagacgcttgtaacaatcgcggtaattttcagccgtctcagactgcagaatcatgccggcaagctgttccgcttcactttgaagcttgacggactcaattgttgcatacataaatacgcacctccagttgctagtttaccatgaaaccacccaattggaaaatgcggcgtttaaacgctttttaatcctgcgaacgcatggcgtgtaccatctgcatcatcatctgcgccatttgaatcccgtttgagaattgacttacccgatgcggtatcgtcttttcataaaaattcatcatgtcaagctgaaaggaattgagatcgtccggttttctcgcaagtctgcggtaccagacgggacgctgccgtataaaccgtttccgttcctcatctgcggatatgaattcctgaacctcttttcgcatacacgatccccttctttaatcctttctgaatgaaaaaggatgttgtccggagccttgccggggctgcttcgtgctgctccccgaaaattggcttaaaaggctttgcaatgatgaaatggactggctcattttattgatctgctcattcatttggttgatatccatctttttgacggcagtgaccatttttgaaacgaaatcgttcttttcagctggttcctgtttggtttccgcgtcggaagaaggctgaacggcctcgtctttaaaagggtcccacatcgaatcatcctcgcccaggagaacccagttttcatagacttcctgccagcttctttgttccttgcgaacattttggatcagtttgggatgcttttttacgaattgtttaaaatcatcgattgattgccgtgattgctgattcgccacaattctcaccccctccgaaaagttttgcctgctataatgtatcggttcatgcgccttaatgttcgcctaaattgcgaaaaaaagcaggtatatttttttcagcaggagcgccgctcgcgaaaaatcataaaaaaaccgcgggggacgcgcccctctgcggttttttactgccaaggcttaatgaagttttgcgtataatacttccggtccacgccgacaccgaggtgcgtataatccgggcttaacagcgccttcctgtggccttcgctgttcagccagccctccacggctgcaggaccgtccacatagttgtaggcaatattttcaccggcctcccggtatttcacatcgcctttttccaagcggtccttcagagtcccgtatttctttgagacgtgagagaaatacttgttatccttcatgtccttgctgtggccgaatgccactttcgcggcgccttcgtcccatttcagccttgccagtccgtgtttcacgcggatgacatttgtaatgtcgagaatctgctgttcactcgctcgttcaatgtcgttccattttttatcagaaactggctcgggttctgtcagctttcctctgtacatgacctcatacggcctttgtttcaccagcgtttccgcatcaaaagccctgatgcttgacagattcccgtcaaatttgtccatgtacagctgaacatacattccgcctatcttgacggtgggacgggtattgatatcttcttcggaaaactcaaaccgatacgtgtttcccttgtcagtcacattgacaaaaggagaaacctgcgtcgttttaaaaacttcgcccgtcgattcgccgatcttaaacggttttgcgttgatgccgcttcccgaagcgtataaagtcacggctttatcattcaaaataccgacttgtacgtattggtctttcccctggttgtacacccaccactcgtaatcgtaggcagaaggatctttccgggacggttccccaagtttctttttcacatcggcggcagatttccccatgagagaaagcagtccggatgacggcattttcagccgttttccgctctcttcttcattggaaacctgaggctcctcctgattggtctttttctgaggagccgatccatattgtataaacagaacatacgctccgtaaataagcaaaaggataacgagagcccttgcaatatttttcaacctctcacccccatatcatcaaaccgttctgtttttgtgtactcttatacagtacagcctatttgcatcgtccgtgatttatgtttaatggataaacccctccggacctccgtcttcagaaatgtcagacagcgcccggcctgcttgctcatttgattgctcggccaacgaaagatcgccgagcgtaacaatgccgaccagttttttatcccttgtgacgggaattcttctgagctgatgttcagccatcaaatggagcacctcctccacagaggcgtcttcttctgcactgataacccgctctgtcattgcgtcggttattttttgagagttcggcttttttgaagcaattccccgtaatacgagatctctgtctgtcacgatcccgacaagtgtggcgccgtcttcatccactatcggaatggcgccgacatccgcgtctttcatcttcaccgcagcttcatatacattatctaatactgtacaatattgcaagtctgacgtcatgagcttattgatctttgtcattgcggaattcctccttttttctgctactattgtcgtcaaatttttgtttttgcatactttcaccgtatgaatcattgaaagtgtaacgctttcatactatgattgtcaggaaagggcatttttaaaaggagggggaaggtttgaagtttgaaaacagcggtcttgaaggggtaacagcggagctcagccgcttgaacgatctgatggaaggcaaagggctcattctggctggacaatgggattatgaaagagtgacttacgacaaaaagttttcagtacctgaggggacattttatctgcggattcaaggaacggcaaaagagggcgatgtcggcggcagacgggccgtgattcagctgaaggcccctcttttaggaaagcattattatccgcacggcgtagaatacggcagcgctgaagaatttccggaacatgtcatcgctgaaagcaaagctttactgcttgaattggaagagtcattaaaaacagtgcaaatgtaataaaaaagtacagcatattctgctgtacttttttttatgagacggtatgctcgatatacggcggctctgacagcgtatctttttcccgttccgttctgacccactgaaaaaagatgacagccaaatatattccgtagaccgcctcttgaatgattttcatcagcactgccccaagctgctgatcttccagaggaggtagcgtgttaaacatctccggcccggataaagggatctcctccagcaaatctaaaggaacgcaaagcttcattgcttcggcccaagccgccggatctgtatacgtggcatacatgggcgccccgctgaacataatgagcgcgcaggccggcgttaacaaaatcccgtccgccataatataccccagcttcattaaaccgctgagacggggcagaccgtccaccttatgcacaagcggccaccacataaaaaacgccgttacaaagatgagtccgttcatcagcgtgtgatacagcgaatccgttttgacgaaatcaaatataaacgggatgtgatacagcgaaaaaataccgttaaacagcactaaagcgataagcggcattgaaaaaaatgaaaacagcggctttacgacaggacggaagatcagttttttccatgcccagccgggaattccggagatcaacagcggcggtacgactaaaaacagaaccgccatctgcgccatatgggcgctgaacatcacatggcccaataaatcgaccggacttcccgcagccgcgtaaaaaaatagcgcggaaagcacaaacagcaccttctccttaacggccacacgtcctttatgccggctgcaccagtaaaagtaaacacctgttatcacggcagttatacaaaacagatacgggctccacattgcgcgaaacccgaacatttccaaattaatcaaatctctcactccccgccgccccgattaccaccaaataatcgtgacaaatgcaagcacggtgataaacgcgacaaatattcccgaatacagaaataatgacggcgcttcatgccccttctggctcatatgcataaagtaaaacagctgaaagatgacctgaatgaccgcaagcaggatcagaaacggcatcgtaaaccatccggcaatgccgtctgcagccaccgtcaaaaacgcgacaagcgtaaggccgatcatcaagccgaaggagatgacctgatatttcatctcctcggcatttttccttctccgatattcaagatccgtactgacagtctctctgtttttgttatcgtccatcgttatcccaccatccccatcaaatatacaacggtaaagataaagacccacacgacatcgataaaatgccaatataagctggccacataatatttcggcgcattataaaggctgagccctcttttcgcattccggatcatgagcgcgctgatccacaacagcccgaacgccacgtgtgctccgtgtgtgccgacgagcgtgtaaaacgctgagccgagcgcagagcttgtaatggtaaatccgaactcgtgagtgtaatgcataaattcatagatttcaacccctaaaaatcccgctcccaataatacggtaaccagaagccacacctgcatttttttaaaggagaaatttttcatatgatacatcgcatacacactcgttaagctgctcgtcaaaagaagcatcgtcgcgataaacacgatcggcagctcaaacatctcagccgttgacggccctccggctttagattcccgtaaagcaaggaatgtcgcaaatagcgaggcgaacagaaccgtttcgccgccgagaaacagccaaaatcccaaaaacttatttttcccctccagcgttgctttttcaggagaagccggaaaggtttcagccgtcattttttcctgcagctgcattacgccttcacccctttatcatcattcggcagatcttctttgtgaatatgatagccgtaatcatcgaccacagagcgaagcagcatggtaaagaatgtgatgccgagccctatgaagataaccggaagcccccatgaataatcggagtggtataaaaacccgaacgctgccacaaacagcccgaaagatatgataaacggcatgatggagccgttcggcatatgaatgtcctctacaggctctgcaggcgccatcccttcatttccggcctgcttttcaatccacagcgggtcaagtccccggacaaacggaagctgtttaaaattatattccggcggcggcgaagagaccgcccattcaagcgtacgaccgtccagccacgggtcgttcccgacgtatttcccctttattgaggtataaataatattgacgacgagtaaagcggccgcgcctgccatgaaaaacgcgccgattgaactgatcaggttgccggtatcaagcccctggccgggcagatatgtgtaaacgcggcgcggcattcccatcaagccgagaaaatgctgaatgaagaaggtaagatgaaacccgataaaaaataagacgaacgaaattttccccatcgtttcatgaagcaccttcccgaacattttcggccaccagaaatgcacgcccgccaggatgccgaacacaacgccgccgataatgacgtagtggaaatgcgctacgacaaaatacgtatcgtggaactgataatctgccgctgcggccgccagcatgacacccgtgactcctccgagtacgaaagaaggaataaaggcgacggcatacagcataggcgtcgtgaatttgacgtttcctccccagatggtcaaaagccagttgaaaattttaatgccggtaggcaccgcgatcgccatcgtcgcaaccgcaaatatcgcattagcgatcggtccgagtcccgttgtaaacatgtggtgaacccataccatgaacccgagaaagccgatcagcacgatcgcaaagaccatagacgaataaccgaacagacgtttcctcgcaaatacgggaatgatttctgaaaaaatcccaaaggcgggaagaattaaaatgtatacttccggatgcccgaaaatccaaaacagatgctcccagattatcgtattgccgcccaattcaggattaaagaaattcgttccgaacaaacgatccagcatcatcagcgccaaaccgacggtgagcggaggaaatgcgaataaaatgagtgccgacgccacaaatgtcgtccacgtaaacagcggcagtctcatatacgttaaacccggcgccctcatattaataatcgtggcgagaaaattgatccccgcaatgagcgtacctaagcctgatatttgcaggccgagcacgaaaaagtctatgccgtgccctttcgaattcagcgcaagcgacgcgtacgacgtccagcctgcatcaggagcgccccctaaaaaccagctcagattcaaaaagatgcctccgaagaaaaacagccaaaatccgagcgcattcaaaaatgggaatgatacgtcacgcgccccgatctgcagcggcacaaccgcgttcatcagcccgaataacagcggcattgccgccaggaagatcattgtcgtgccgtgcatcgtcataatttcattaaactgctgagcacccataaaatcgttccccggcctcaagagctgaatcctgataagcatggcctcaagtccgccgacgacgaagaaaaatcccccggcgatcatatataaaatcgcgattttcttatggtcaaccgtcgtcaaataatcccaaagcaaagagctttttctttgctgtcctgtaagcgtattcatcatttgcgacctcccccctgatatctccctgtcctcacttgttctccgctttcagcccttttaaatattcatacagcgcatccgtttcagcgtccgagagcttcggataagtgcctgtcattttattgcccggtttaatgctgtccggatttttcagccaggcttttatattctctttattcgcatccttaatgccggccactttgacccgttcaccgaaggtagcgaggttcggagccgttcttgccgcttcagcccgtttatcattgggctcaaccgcatgacagctcaggcagtttttttccttaaacagctcttctccttgtgctgctaaatcggaatctgttgtatgcttataatttttcatcgctttcgtccattgtttaaattcttttgacggcagcggtttcactttgaaatccatcagcgcatgtgaaggtccgcacagctctgcgcatttcccgaagaaatattctcccgcttctttgctgcgtttagaatcgaaggtcagaaagaaagtgttgtcattatccgtattcgtatcgatttttcccccggctgacggaatccagaaagagtgtttcacatctgaggacttcagcttgaaatagacgcgttcatctgtgggaacgatcagctcctgacttgtcacaaacccgtaatcgggatactcgaattcccaccagtataaattcgcccttacattaatcacgagcgcatcctctgctttacggtttttcttatccatcggcgacgtatccgccagtgccaatgtatcgatgacaaccggaatgacaagaataatcagaagcaggatcggaataacggtccaggtgatttctaaaaaacggttcccctccacctgtttcggtatcgtgtcttcccctatacgcgaccgtctgaatctcacaatgacgtaaaagaaaataactgctacgaccgcaacgacgacaaccatgataagtgtgctgagcaccgtcagatcatattgtttatcagccacttcgccggcaggcttgagtgtggacagaaacggttttccacagccgctcaataaaagcggcactaaggctaataatgataaaagacgccaacgctttaacatttcacccaaccccttttttgaatcagtacgagatgcacaagcagtaaatctgcttccagccgaaatacttcatttcctcatttcttaaaatatgagattttttacttaaaattccatctatgtataaaagcaaagccgcctgattaaacaaaaggtcaaggcggcgtttactagttgtcattgtttgttttggcgatcaaacaagctcattattcaattaaaacagcgtgaagaccaccatcgctacaaaataaatggtcatgtagttaagcgaatagacaaacataagggttgcccacttcatgatgtttttcatgcggaatcccatcagtccgagaacaagccatccgacattcagcaaagtgccgagaatgacgatcggaagaccgagactgccgaggaaaaacggaagcggcagcaggcatgcgacccagacgataatctgtcttttcgtcacttcaaagccgtgcactaccggaagcatcggaatattcgctgctctgtaatcttccgtctttttaatcgcaagcgctaaaaagtgcggaatctgccagatgaataaaatcatgaataaaacccacgcgacaacaccgatgtgcccttcaaccgctgtccagccgattaacggcggcacggcgcctgatacacttccgacaaccgtattaatcgtataacggcgtttcgtccacattgtataaagaacaacgtacgtaaacacgccgataaaaccgatgactgctgccatcacggtggtcatcaaaagcatgataagtcctaaagcaatgagtaaaattcctgaccacagcgcttgattcggctgaatctttccggttaccgtcggtcttactttcgtgcgttccattaaatgatcaatatcacggtcgtaatagttgttaaccgcacaagaaccggcgatgatcaaagaagatcctattaatgtaagaagcacggtgtttaaattgcctaaaaaactcagaccggatatatgtaacgcaagccacatgccggtaaaagtcgtaattaaattcgaattgacgattcctattttgataagcgaaaggaaatccttccatgccgtcgtctcttcaatctgtccgtctatagctgtatcgtttaaaattctggaattagccataacgtaaacctcccttacaaacctaaagcaggttttttaagacctgcaactctatcatacaagataatgacctgtaaaaaaacatcctcttaaatattaaacgagaaacaggaatttatttgtgaactttttatgaattttaccaaatccgccggcttcataataaagcggttactttatttctatcagacccatctggaataatcaaccccattatctaagaagtcctgattctattatatttttgtgaacaaacagaattgagaattgccacaaaacacatattcgcttacacttggtacgtatatcattttgtccagtttgttaagaaggtgaatgtaaaatgaataaagctttgaaagcgctcggcgtgctgacgacgttcgttatgctcgtcgtgctgatcggcggcgctcttgtcacaaaaacaggatcgggtctcggatgcggaaggcagtggccgctttgccacggccggtttttcccggagcttaacgccgcttctatcattgaatggagccacagactcgcaagcggtgtctcaatcgttctcgtgctgagtctcgctttttgggcatggagaaaagtcacgcctgttttccgtgaaacaacctttctcgccattatgtccattatctttttatttttacaggcgcttctcggcgcattagcggttgttttcggatcaaatgcgctcgttatggcgcttcatttcggcatatcgctgatttctttcgcttctgttctgattttgacgctgctcatatttgaagctgataaatcagacaaaaagctcgtcaagccgctcagaatcggcaggaaaatgcagtttcatatgatcggcctttcgatttacacgtatatcgtcgtttatacgggggcttatgtgcgccatacaaaatcaagccttgcctgtcctgacgttccgctttgcagcagactgaaccacggacttccgtctcattttcaggagtgggtgcagatgggccacagaacggcagcgctgcttctgttcgtatggattcttgtcgcttttgcgcatgcggtgcgctcctacaaagaccaaaaacagattcttgggggctggatagcggctcttgcctttgttgtattacaggcgctctccggaatcatggttgtttattcagaaatggccaccggctttgcacttgcccattcgctctttattgccggtctgttcggtgtcttatgctatttcttattattaatcgcccgcttccgctatgaatcaaaacagcggaacatctgaggcacatgaaaaggccgaagcatcaaagcttcggccttttcacatataaaaaacctgatcgcacacggggcggatcaggttttttatgtttattttttacgctttttcaatttcgatcagtaaatcgcctgtctgaatcggttcaccgtttttcacatgaatctgctgtattgtcccggagaacggcgcctgtaccgtcgtctccattttcatcgcttcattaatcatcagatgatcgcctttattcacctttgccccggtttccgttaacaatttaataaccgttcccggcatggatgccgcaatgtggcttgggtttgtccgatctgcttttaatttttcctgtacggacgatttaatgctttcatctttaatgaccacttcgcgcggctggccgttcaattcgaaataaacgacacgtgtcgcatctggctgcggttcaccgatagatacaagcttcacgatcagcgtttttccgcgctcgatttccacttcgatttcttcaccgagtgtcatgccgtagaagaaagtcggtgtgtccaatacggaaatatcaccgaagcgttcagccgttttaacatattcagtaaatactttcggataaagagcatacgcgattgcgtcctgatcactcaattccatctgatgcgtttctttccattcttctttaatgccttcaaaagataccggttcaagcagctcacccggtcttaccgtgatcggcgtctgtcctttcagaacgagcttttgcagtttttccggaaatccgccgtgcggctgaccgatctgccctttaaagagctcaacgactgaatccggaaaatcaagcgtttcgcctttatcataaacatcttgttctgttaaattgttttgcaccatgtaaagcgccatatctccgacgactttggaagaaggtgttactttcacgacgtcgccgaacatgcggttgacaacgctgtacatgtctttcacctcattccagcgatcgcccaggccgactccttttgcctgctgctgcagattgctgtactgcccgcccggcatttcatgattataaatctcagtatgcggagacttcatcccgctttcaaattcactgtaatactgacggacggattcccaatattgtgacagtctttccacctgccggacatccatttcaggacggcggctgtttccttcaagcgcatgataaaatccgcttgcgctcggctgtgaagtcagacccgccattgagctgacggcgacatccacgatgtccacacccgcttcaacagctttggcatagagaaagacgccattgccgctcgtatcatgcgtatgaagatgaacgggaatatcaatcgtttccttcagcgctgagacaagttcgtatgcggcttgaggtttcaaaagaccggccatgtctttaatgccgagaatgtgcgcaccagacgcctcaagctctttcgccatagaaagataatattgcaaatcatatttcgtccgggtcttatcaagaatatctcccgtgtaacaaatcgcagcctccgccacttttccggtttcacggacggcatcgatggccagcgtcatcccttttacccagttcaggctgtcaaagatccggaatacgtcgataccggactccgctgactgccggacaaatttttgaatgacattgtcgggatagtttgtataaccgacggcatttgatgaacgaaggagcatctggaacaatgtgttcggcacttccttacggagatcttcaaggcgtttccaagggtcttcttttaagaaacggtacgctacatcaaatgtcgcgcctccccacatttcaaggctgaacagttcaggccacagggcagccgtaggattcgcgatttttttcaaatcgttggacctgatccgtgttgcgagcagggactgatgggcatccctgaacgttgtatcggtcaggagcacggatttttgctctttcacccagtctgcaagtccctcggcgcctctttcatcaagaatctgtttcgtaccgcttgccggcttttccccgatatctaacgtaacggtctgaggcttatcaaatgcaggtttttcttttttcccgattcccggaaaaccgttcaccgtgacattgccgatataggaaagcatttttgttccgcggtccttctgttttgggaaaacaaacagctcaggcgttgtgtcgataaacgatgtgtcgtattggcccgtcaggaatttttcatgctttgccacgttttcaagaaacggaatattggtcttaatgcccctgatcctgaattcctgcaggttgcggaccattttcgctgatgcctgttcaaacgtcagcgcccatgtcgacagcttgacgagcagtgaatcataataaggtgtgatgacggcgccctggaagctgtttcccgtatcaaggcggacgccgaaaccgccgcctgagcggtaagccataattttacccgtgtcaggcataaagtcattcagcggatcttcagtggtcacacgtgattgtatcgcatacccgtttgtaaaaatgtctttctgctctgggatattgacggcgcggctgtgcagtccgtggccctgcgcgacgagaatctgcgtctgaacgatatcaacccccgttatcatttccgtaatcgtatgctccacttgtacgcgcgggttcacttcaataaagtaaaattcaccgcccgctacgagaaattccacggtccccgcgttgatatagccgacatttttcgcaagcgccacagccgcttcacagatttcgtcccttaattcaggctgcaaagatacactcggcgccacttcaatgaccttttgatggcgtctctgaacggaacagtcccgctcatacagatggacgacattgccttctttatctccgatcacctgaacttcaatatgcttaggattttcgatcagtttttcaacatacacttcatcatttccgaatgcggctttcgcttctgatttggcccgctcaaacgattctttcaattcgctttcgcttcggacgattctcatgccgcggcctccgcctccgagcgatgctttaataataaacggaaatccgtggacttttgcgaattgttcgacatcttttaatgtttcagccggtccgtcactccccggaataacggggataccggctttttccgcctgctccctcgcctttaccttatctccgaacatatccaaatgcgctgacgtcggtccgatgaatacgatgtcctcttcttcacagcgtctcgcaaattggatattttcagagagaaatccgtagcccggatgaatggcatcaacgccgtttctttttgcgatctcaataatcccttcaatatcaagatacgcgtcaatcggttttttgccttcgcccacaagataagcttcatccgctttatagcgatgataggagcccgaatcttcttttgaataaacggctaccgttctgatgttcaattctgtgcacgcccggaaaatccggatcgcaatttctcccctgtttgctactaacactttttggatggattgttgtgacaaacttttctcccccttggcctaataaatatgtagtttataataaaggaatatccgccctgtgtatacacttgttttttagagatacacagatttttccgtctgccgtctttttacccctttagacggaacgggctccctctttttcttcttttctgagtacttgacatgcatgctgacattcaccaatataccggcgctcgtcaataacaaaaacattgatgatcccccgtagctgataaacggcagcggaacacctgtgatcggaattaaaccgctgacaccgccgagattgataaaggtctgaatcgcaatcatgctggatatcccgattgccaaaaggcttccgaacggatcttcacattttctcgcaatataaaaaccttttaacaccacaaaagccagcagcacaatgacaaacaggacgccgaaaatgccgagctcctctgaaataaccgccataataaagtctgtatgcgattcaggcagataaccgtatttttgaatgctttctccaagaccgagaccgaaaaaaccgcctgagccgatcgcataatacgaatttataatctgcagacctgatgtgctggcgtatttaaatggattttcaaggctttcaaaccggctcatacgcccgggtgtcaaaatatcgtcccatttcagataaatgatcgggctgacaaggagtaatacgattcccgccatgagaaccagcctgagcagggtccttccgctgaatcccgaacacataatgacgcaaaacgcgatcagaccgataatcatcgccgttccgaagtcgggctgaatagcgataagcgcacaaatgactacggtgacgatcaccggcggcgcaacccccgtcaaaagctgatcgatgtagctttgtttctttgcgtacaccgcggcaagatacagtatcagggtcagcttgacaaattcccccggctgaatggccattccgccgattttaaaccagctttgcgcatttccggcaacatgtccgaaaacaaacagcgcgcaaagcgcagccactgacgcaagcagtatgattttctgaatcttttgatgggcgaacactttgtacggaaaaacggccgcgataataaacagcacaaaccccgcgatgacggcgaacagctgccgtttaaagaaatagtcgctgctcacgccgtaacgcataacggcggtaatcatgcttgagctgtataccattaccaatccgaaactgcacagcagaatgatagcgcatatcaatgaataatcgtaagattttaacattcttttaaacataacatcctctttcctgcttaaagcttacgtttaatacctattgcgtattatattttactataattcataaacaatttacgcagtttctttatagtttttcggatgaaatgcagattaagagaccgtcttacgaaaagaagatgcaaaaaaacggtttacggttataaaaaaacccaaaccgttgaatagtttgagtttgatcatttattttcctgtaaacgcgtcatgcaaagcagacagttctctttcaagtctgtccagcagctctttgccgtcgttttcgtcaactaatcccaggcggacagcaaaatcgatttccctcgacagtccgaacatctgagtatccaagacctcttcatacagaggacattgaggcatcgttaagttatccatttgtactcggatcagcttcaaaatcttctcagcatctaacttcaacagctcgaatgctttctgctgatggtcaactataatctctgaagccaaaagtatccctccgttccccaggcgagtacctaattcttctatttatcataaagggtatcagatgaaattgcaagaggatttaagcagatgttatgataaaaaatgtttcaaaaaatactcagcctgtatttctcagacatgatttccaaaagcttcacacccgcgatgctgttgcctttttcatcaagcgccgggccgaatataccgattccgaagttgtacggcgaaatgcccatgattcctcccgaaacgccgcttttagcgggaatgccgaccttgattgcgaattccccgctcgcattgtacatgccgcatgtcaccataaacgtcttgcagattctcgccacatcttttttaatgacctgctccccggtttccggatgcttgccgtcaagggcgaatacacagccgattttggctaaatccagactgctcatcttaatcgcgcactgttttgtatacaaatccatgacctcttcaacatcgcctttaaaaatgtcatactgcttcatgtaataacacatggcccgattaatcatggaagatttgaattccgattccgcgacatgtctgcaatatgtaatgtcctgattgttcgcaagtcttctgatgaatccgagcaggtaatccaggcggtctttcggcgaatgccctttaattaaacccgtaacgatgagagctcccgcattaatcatcggatttaaaggcttgcccggattcactgtttcaagcttaatcatggagttaaacgggtcgccggtcggctcctgacccacgcagctgaacaccttttcctttccgtaatccatcagtacgagcgccagagaaagcactttcgaaatgctctgcagcgtaaatgtccggtcggcgtctcctgccgtcagacatgtattttccgcatgataaatcgtgaccgaaaggctgtcttgttcagattcagccagagccggaatatagtctgccactttgccttctccggttctttttttcgcttcctgaactaatgcgtccagctcttggtaatgccggcataccatgtcgatcatcctcacttcgctgccgttgtatacatctaatttgcaacgcaaagtgacaattcatgcgaaaacttttatactttaagtaaaggggggcttcaacatgagcgttattcaagtaaaaggcaatgttacatacccgattacaattgatccgagtgtctggattttcgatgaccgcaaatttccgtttgaaaacaatcagcctgttcatcaggacggctctgcagaaacccaggagcatacgcttgatcctgaacgggtgatcagagaagggcgcatttcgccgccgactttaaaaagtgaaaaacgttatgaaaaagaaagactgatgaacggcagcttcgccatgaagctcggcgctgttttagcaaatgccgagccgaaagaaagcgctgtcctgtgcgcatttatttcaaaatcagaaagaaccgaagtgccgcttgaaaaggcgatggacgcaatcgcgcatttcagcgatgcggggaaaccgcttcaagacggcggtccggtccatttttacgtggacggagactttgaaaaaccgataacgggcgtcacagaaatcgaagttttataacaaatcggcggcaagctgtgcaaggccggatctctcacctttcacaagcttcacgctgccggagacggtttgtcctttaaaccgctctacaacataagcaagtccgttgtttaaactgtctaagtatgggtgatctatttgctccggatcgcccatcaggacaattttgctgccctctcccacccttgtcaaaagcgttttgacctcgtgcctcgtcagattctgagcctcatctataataataaactgatccggaatgcttcttccccgaatgtatgtcagcgcctccacctgaatcgatccgattcctgccaaaatcgcttcaagttcacccggctttttcgcattgaataaaaattcaagattatcaaagatcggctgcatccacggcttgagcttttcctctttttcgcccggcaaatatccgatatcctttcccaccgggacgatgggacgcgcgacgatcagctttttataaataccgagatcctccgtctgcagaagccctgccgcgagagcaagcaaggtttttcccgttcccgcttttccgatcagggtgacaagcgggatatcttccctcagcaggagttcgagcgccattgtctgctggacgttcttcggcctgatcccccatacgtgctcatcatcgaaaacgagtctttttacggtctctcctttcttatccgccatgccgaccgcagacgaagatcctcctaattcatctttcatcagcacaaattgattcggataaacctgatgctgctgaagctccttgactggaatttgtttgtttttataaaacgaggcaaaccgctctttattcataaatatatctttgtacccgctatatatttcatgatggtcaacgactctgtcgtttaaaaagtcctccgccaaaagcccgatggcatccgcctttaccctgacaagcacatctttgctgaccaggatgacgaggcggccgttttctttcgtttcctcctcaaggcttaaattttttgccaccgccaaaatgcggttatcattcgttttttcgataaaaatttcttggagctgatgaaatgaccggtggttcagttcaattctgagcgttcctccgctttgaagcggaactttctcgtgcagccttcctttctccctgagcccgtctatcagcttagatacgtgcctcgcatttctcccgacctcgtccatataccgcttttttgaatcgacctcttccagcacgacggcggggatgacaacttcgttttcttcaaaggaaaaaatggcgttaggatcctgcaaaagtacattcgtatctaacacataaattttactcaagtctcagcctcctgaaataaggatcaaagcccatcgtgtgcttctctttccgcgaaaaacggggatgcctgctaaaatatatgatttggtgaataaagatagaaggttaattcaacaataaaataaatgaaagcattcaaggagggaatctgacgtgcgaattcttttcattatcatacaagccttgtttatcctgaccggctgcactgctgtacaggacggccgcggccgcaatatccagaacgaatcaaccgatcagcgtgatgcaaaaccgattcatgtaaaaaatacggctcctgagacagctgaaaatcccggccggacagacatcgctaagcatctcgtcgaggtaaccgaaaaaatccccggcatttcagatgccaccgcggttgtactcggaagatactccgttgtcggaatcgatgtggatgacaatttagaaagaagcaaagtggagagcattaaatacacggtcgcccaggcgttaaaaaacgatccttacggcgccaatgccgttgtcgtggctgatcctgatacggtttcccgtctgagaggcatgggcagcgacattaaagccggccgccccgtttcaggcattttggacgaacttgccgccatcgtcggtcgtgtcatgccggaagtcccgaatgatgtgaccgacaatgaaaaagaatcaccgactcaatcgaatgatgatcagctgaaccaaagagaccagaacaagctgcagaacgaacagaacgatcaatcggatcatcatatgaaaaaccgccagtaaaaagcagcgcccgctccaaaagaagggcgctgctttctttccctttggcaggaggggcatccatgatataatgcttgtcatagtgaaagaggtgaaaatcaatgagagtaaaatgttccatttgcgacaaaattgaacaaattgatgatgaaacactgacagccaaacgcctccgcaatcgtccgattcatacatatatgtgccgggaatgccatgaccgaatcaaaatcaaaacggaggcgcggctgaataccggacacttttcctttcatcctggacaaaaagcgaaaaaagataaactgaaaaaataaaccgcaataaaaaatgacccgccggaaggcaaggtcatttttttattgcggtttagctgactggctttttttggactggtgcagacggattttgtaaatgatcaaaatcaaggcggcgacaacaagcccttctccgaccggcaaaaacacaccgaaaaaagtcagcacggtgcagccgagcacgagaaagagataaactgccgcagccttcaaaaccggcagccgtttggcaaagccgagtttaaatacaatcaccgaaagcacgacgatcgttccgtataacagccacattcccgccagcggatgctcatccacttggtaaagagccgcaaagaacgacagccgttcacttacttcattcaaaaagatccccctccccttttccgttcgggttctaccttttcaaattctgcaagtgattaagacattcctgctgtttttttctttttcgccgctttttcacgttcgtttttattcaggattttctttcttaaacggatggattccggcgttacttcgcagtattcatcctcgtttaagtactcgagtgattcttcaagcgacataatgcgcgctttcttaatcgtagtcgtttgatccttcgtagcggaacgtacgtttgtctgctgtttcattttgctgacattgacaacaaggtcattgtcacggttatgttcgccgacaatcatgccttcatacacttctgttccgggctcaacgaagatgacgccgcggtcttcaataccttgaattccgtaagatgtcgcttttccgttttccatggaaacgagcacaccctgacgtcggcctccgacttggcctttttgcatcggctgatagctgtcaaacgtgtggttcaggataccgaaaccgcgtgtcagtgacagaaactcagtagaatagccgatgagtccgcgtgaaggtacggtaaagatcaggcggacctggccgtttccgttattaatcatatcaagcatttcgccttttctcgcacccattgattccataacagaaccggtatgctcttcaggcacgtcaatctgcacgcgctcaacaggctcgcagctgacgccgtcaatttccttaatgataacttcaggtttagacacttgaagctcatagccttcacggcgcatgttttcaattaaaatggacaggtgaagctcaccgcgtcctgaaacaacccatgcgtctggtgatgcagtcggttcgacacgaagactgacgtcagtttgaagctgcgcattcagacgctcttcaattttgcgggctgtgacatatttgccttcacggcctgcaaacgggctgttgtttacgacaaatgtcatttgaagcgtaggctcatcaatgcgcagaaccggcagcggctcatggtggtcagccggacaaaccgtttcaccgacgttgatgtcttccatgcccgaaacggcaacaaggtctcccgctctcgcttcttcaatttccacgcgtttcaatccttggaaaccgaagattttcgttacacggaatgatttaaccgttccgtcaagtttcatcaatgaaacctgctgacccactttcatcgttccgcggaaaacgcgtccgataccgatacggccgacataatcattgtaatcaagcagcgccacttggaattgaagaggctcttcggcgttatctaccggggcagggacatgttcaagaatcgtttcatacagtgattccatgttttcgtcctgctttttcggatccagacttgccgttccgttaatcgcagaagcgtagacgacagggaactcaagctgttcttcgtttgcgtcaagctcgatgaacaaatcaagcacttcatcaatgacttcttccgggcgggcgaaatcacggtcgattttgtttacgacgacaaccggatttaagttctgctcaagggcttttttcagtacgaaacgggtttgcggcatgcagccttcataagcgtcaacgactaacagaacgccgtcaaccattttcataatccgttctacctctccgccgaagtcggcgtgtcccggagtgtccaaaatattaatgcgtgtatctttatagttaatcgcagtatttttcgcaagaattgtaataccgcgttcacgttcaagatcgtttgaatccattgcgcgttcggcaatattttcgttggcacggaatgttccggcttggtgaagcaattggtctaccaaagtcgttttcccatggtcaacgtgggcaataatcgcgatgttgcgaagatcgtttcgaagtttcacattttcatctcctaaaaaaattagataactttcatattataccacacatcctctttaaaagcgttacgtttttctgtaaactgaaagtatgacgttaaaggggatggaaatatgaaaaaattgaattggctcttattattatttgcattcgcagcagtcttcagcatgatgctgatcggcgtatcaatcgctgagaaaagcgcatggggcatcatcggaagcattgttctcgttatcgccatgatgggaagcggtttcaccgtaaagaaaaaaatgcgcgaacagggactgcttgattaaaagcatgaccctttgcaaaattccgtaaacatggaaagacaatatcttatgaagcctgaatcaaagattcaggcttttttacctcctcaaaaacagactccagatgtaaggcttatctcccccgccgtctagtcaggaagccgggaatgacggcccccattctagttacatcagcagattccctcagaatatacagtctgaaatagtccggcatcgttatgcagaaaataccatacctcctatatcaattccatcattgtctttttatacttgtgactgtaagcaaatacacatgacaaggagagaatgaaatgaaaacatcttttttgaagaaaaccgctgtaactgccgccgcaaccgcctcagccgccttgcttgcattcagtccgcttgattctgccggcgcaaaaacgatccaggcaaatgaaccgcataccctgcaggtttccgcagagaaaacaccggaagacgcggcaaaactcattgacatcatcagccaatcgatttacgaaaaagacggcgtctattattttgacggtgaaaaagcggttgaattgggattagataaagaagccgcacagaccattcaaaagctgtgggacagttcaaccgaatttttaaccgttctttctcaatgtattgagaaaacggacggcgaatatacatttaataaagaaaaagcggtggagctcggatttacggaaaaagaggcccttatcgttgatcagctgttcaccactttttcccaaagtcttcatatccttcaatctgcgctgattgaagaagacggtgtgtatacgtttgatcaggaccttgctgaaaaagcaggagcaggaaaaaaagaagcaaagctgtgtgccggattctttaattcactgcctcaggacttgcttgaaggcatttatacagcctttcatccggctgagtaaacggataaaacgcccggtcatgtcatgcagccgggcgttttttttaatcagcagtttaaagatcagcatgataaagaaaacagcgccgaacaaacaggctgcttttatcagcagcttcccgtaataccgttccttaaaccgcctttcttcttctgcataacaggcgggctccttcatctcggggctgccgaggtcaagcggctccttcatcatatgatataaactttcgcacttaccgcatgattcaaggtggcgggaaataaaccgctccgtttctgtttcacaatcgccttcaatatatatagggagtaaatctctcactaaacagcaagtcatatctgtccgtccttccttttttccgctaagtgctgtttcagctgcattctcgccctgtacagagtgctcttcaccttcgaaagactccagtccaaaacatcagcaatctcttcgtaagacagctcttgaaatatctgtcgaaatgctgaataaaatgactgaaaatctctgacatctgaaacaatccttttcgtttattaaggcctcacctgtttagacaaacggctataaaaaaagttttacagatcggaacatttttcctctattatttctcccgacttcatttgtcatttttttcagaataaatcgcatcattcgactcatgtttgattcaacacgtgcctctcggcttatcccctgacgctgcccgcctgaagcctttacgggacgattctatcaattcatcagcgaagtctagttttatattgcagaatgagagaatgctggtttattataacaatataagttttcattattttcaaaaagggggatttattgtgggtttaggtaagaaattgtctgttgctgtcgccgcttcctttatgagtttaaccatcagtcttccgggtgttcaggccgctgagaatcctcagcttaaagaaaacctgacgaactttgtgccgaagcattctttggtgcaatctgaattgccttcagtcagtgacaaagcaatcaagcaatacttgaaacaaaacggcaaagtcttcaaaggcaacccttctgagagactgaagctgattgaccacacgaccgatgatctcggctataagcacttccgttatgtgcctgtcgttaacggtgtgcctgtgaaagactcgcaagtcattattcacgtcgataaatccaacaatgtctatgcgattaacggtgaattaaacaacgatgcttctgccaaaacggcaaacagcaaaaaattatctgcaaatcaggcgctggatcatgcttttaaagcaatcggcaaatcacctgaagccgtctccaacggcaacgttgcaaacaaaaacaaagccgagctgaaagcagcggccacaaaagacggtaaataccgactcgcctatgatgtaaccatccgctacatcgaaccggaaccagctaactgggaagtaaccgttgatgcggaaacagggaaagtcctgaaaaagcaaaacaaagtggagcatgccgctgcaaccggaacaggtacgactcttaaaggaaaaacggtctcattaaatatttcttctgaaaacggcaaatatgtaatgcgtgatctttcgaagcctaccggaacacaaattattacgtacgatctgcaaaaccgacaatataacctgccgggcacgctcgtatcaagcactacaaaccagttcacaacttcttctcagcgcgctgcggttgatgcgcattacaatctcggcaaagtgtatgattatttctatcagacgtttaaacgcaacagctacgacaatagaggcggcaaaatcgtatcttccgttcattacggcagcagatacaataacgcggcctggatcggcgaccaaatgatttacggtgacggtgacggctcattcttctcgcctctttccggttcaatggacgtaacggcccatgaaatgacacacggcgttacacaggaaacagccaacctgaactatgaaaatcagccgggcgctttaaacgaatccttctccgatgtattcgggtacttcaccgatactgaggactgggatatcggtgaggatattacggtcagccagccggctctccgcagcttatccaatccgacaaaatacggacagcccgaccattacaaaaattatcaaaaccttccgaacactgatgccggcgactacggcggcgtgcatacaaacagcggaattccgaacaaagccgcttacaacacgattacaaaaatcggagtgaaaaaagcggagcagatttactatcgcgcactgacggtatatctcactccgtcatcaagctttaaagatgcaaaagcagctttgattcaatcagcgcgggacctttacggctctcaagacgctgcaagcgtagaagcggcctggaatgcggtcggcttgtaaacaagaaaagagaccggagaaatccggtctcttttttatatctgaacatttcacaatggcttcaccatgatcatatatgtcttttcccgatcgtctttttcaagcttaagctgttcaaagccgcattggcttaaaaacaaaacccattcctgcctgtccaggggaacggctgaaaacatcgctttatgctctcctctcagccggcccgcaatctcttcaatgaccgcgcgaccgattcctttctcttttgcctccggagcgacggccacggttccgagccacggttttccgtttgaaggcgcccattccaaatgaaaactgacggcggcaggagcgccgtcaatctcccatacgagccacgttccattgtacatggagtatgcaagcataaactccgccgcattttttgttccgaactcttcgtttttccacaccgggtgtgatgccgccagctgctccagaaacccgagatcttcttcttcaaaatctctacctgtcagcatgtaaatagtcgtcaaagataattttatgtatagccggattgcccgcaagcacgctgtggttgtctaaaaacgtgaacggttcgccgtctgtggtcgtgtaaatgcccccgacttcgttcagcagcacgcagccggcagcgtaatcccacggcgcgagcctcatcgtaatgtatgcgtcaatgcggccggccgcaacaccggccagctcaagtgccgccgaaccgtaggaacgcgttcctctgacccgttttacgagcggcgccaaaatactcgggtcaatccttctgttttccgtcacccatgtggcattgattgcaataatggcttcttcaatggaagcttcttttaaaggagcaagcggcgtatcattcagataagccccttttccgctgaatgcgtgatacagttcgtcctgcatcacatcataaattaagccgattttgccttttccgtcttcaaagatgccgatggagatcgcgaaatgccgcttttgatggacaaaattcatcgtcccgtcaatcggatcaatgatccagacgattccgtcaagggagcggagtttatccccctgcccttcttctccgagaatccggtgtccgggaaaagttccttgtatacggtcaatgaaaaagcgctccgtctctttatcaatatttgtgactaaatcattcggatttgattttgtttcaatcgtcaagctttcctgcatggattgtctgattctcgttccggcttcttttacccattgttttgcgatatcatcaatttccgtccaatttgtcataccgtgtacctcttttctatgtatagcttattctatagcatactgataaaggcgatgaaaaagcaaggaaaatgaaaaaaatgccttctcacgtaaaaacgaaccatttcctgcggttcgtttttactattctttatccgttaagccgaatccattcttttctgagacgttccagttttcttttgctgagatcgatttgatcttcattctctttttgcatggcctcgtacagggttgccaattcataatcaacctctagtctccagacagctacacggttatttttttcctccctgaatccttccttcaccacttgcctcattgtctttcgccccttccagagatcatttgttaaaaaagcatcccatttttccaattcattaatgatacttcttatatcgtatggaaacttatattcggctgtaacaacattcttaaaattgtgtgtttacctattcgttttttaccaccattcctctcgactcaaacgttctcaatgtttttgcggcgggcggcggctgtggtaaaatatgaatacttacgttaaggaggaaaaagatgactcagatgcgttttacaaaagaagacttcgatacatttacaatagaaggtttagatccgcgcatggaggtgttaaaagaacaagtccgtccgaagctgaccttgttaggagagcatttcgcaccgacattgtcagcattgacaggagatgaaatgttcccgcatgtcgccaagcacgcgagaagatctgtcaacccgccggctgacagctgggttgcctttgccaacagcaaacgcggctataagaaactccctcactttcagatcggtttatgggacacccatatgtttgtatggtttgccatcatttatgaatctccgataaaagaggaatacggcagattgctggaagcgaagcaggaggaaatcacaaaacagattcccggtcattttgtatggtcgccggatcatacgaagccaggtgcgtacaagcagtccgacatggatcaggagcagctgaaaacattatttgaacgcctgcagacagtgaaaaaagcagagcttttatgcggcattcagctgcaaaaagaagacgtgatcaacatgaacaacaatgaattcctgcaaaccattgaagatgcttttaggaagctttcctttttatacacactgactcagaaagtctcataacataaaaagcgggccgattgccggctcgcttttgtctacattttgataatcgcttgatctgattgtttcgcctgtttcacagtccgatacggggaataggtgctgtcagcttcaaattggctgcagattttcttttcttccgctttcccgggaacgatttctttaaagcggcggtacgcattcagaagtctgtctcggtcagctcctttttcataggcgttttccacctgctgaaaaaaagcaatgacatccacggcctcctctgtcgtccagtcctcattcatcggatattgatattccaaatgtcttcactcctttatcatcatgctcaaaaataagcatcttccatagatcataaattgttctttactttctttcaagttcataatataattcatttgttttacgtttaaaaaacgggtaataaaactgaatgtaatacaaactaatccgtaggtattatgataaaggtgggaaaacaattgccgcaacatgaaacacccctgtacagcggactgaaaaagcacgcggacagacagcctgtccaattccacattccgggccataaaaaaggcgcgggaatggatccggaattcagacaatttatcggagaaaacgcgttaagcatagatttaattaatattgaacccctggatgatttacatgcgccaaagggcatcattaaagaagcccaggatctggccgcggaagcattcggcgcagaccataccttcttttccgtacaagggacgagcggcgccattatgacgatggtcatggccgtatgcggacccggagataaaatcatcattccgagaaacgttcataaatccattatgtcggccattgtattttccggagcggtgccgatttttatacacccggaaattgacgatgagctcggaatttctcacggcattacgcttgagtccgccgagcgggctttgacggaacaccctgacgcaaaaggcctgcttgtcatcaatccgacatacttcggtgtggcagctgacttgagcagcattgtaaagctcgcgcattctttcgatgtgcctgttcttgtcgatgaagcgcacggcgtgcatattcattttcatgataagcttcctctgtccgccatgcaggcgggcgctgatatggcagccacaagcgtgcacaaattgggaggctccctgacgcagagctccattttaaatgtgagagaaggccttgtttccaaagaaagagtacagtcgattttaagcatgctgacgacaacgtcaacatcctatctgcttctcgcttcactggatgtcgcaagaaaacgcctcgctacagaaggccgcgatcttcttgaagatacgattctgctggcggatcagacacgggaacgcctcaatcaaattgaaggcatccgctgtgtcggcgaagaaatcactgggtcaaaagctgccttcagttatgatccgactaaattaatcatttcggtcaaaaacctcggcctgacgggtcatgacgttgaaaaatggctccgcgaatcatttaatatcgaagtcgagctgtccgatttgtataatattttatgtattttcacccccggagacagagcaggagatgccgaccgtcttgtaagcgcgcttacagacatttcaaagcaggcttccgcaaatgattatgctcatcagcaaacggaagttctgcttcctgagattcctctgttagcgatgacgccaagagacgcgttttacgcaaatacggaagtcattccgttaacagaatccgcgggacggatcattgcagagtttgtcatggtgtacccgccgggaattccgatctttattccgggtgagatcattactgaagaaaatatcagctacatttttaaaaacttggacgccggccttcctgtgcagggtcccgaagatgccacgcttgaaatgatcagagtcatcaaagagcaaaaagccatccaataaacataaagaagcccgaaacgaaatcgtttcgggccttttttacgctttttactcttcttcaagatgacactggcattgtccgcagcatgttccgtataacgtcgtgaccttctcatcctcaaagtaatgaatcgcttcgttacagtcttggcaaacaattgtacccatctgtcattccccatttctcagaatttgaaaacgcttaatttttacttgttgttattatattattatgtcacatttaatatgtcaactgataaattgtataacacatttattttttacggtctttttatagctcgagggttaatcacggtatatcctttatgacgcaatccttttacaatgtccggcatggcttcagccgtccatttccggtcatgcatcaatatgttggcgccgtcccgcaggtaaggactgctcagtgtgatatcggtaagcgcttttttggattgatatttctgatcccaatcatacccgaaggtccagttcattttcaccataccttctttttttataagtctgtcactgtagtccgtattgcttccgaaaggcgccctgaaaaatgcgggtttctctcctattaccttttcaaccgctttattgacgccaatgatttcttcccgttgtttttgttcggaaagatcttttaagttttgatgagtcattgtatgatttccgatcataaaacctaactcatgaatatgcttaagcgctttcttattttcatcttttttcaaaaaatgtccgtttacaaaaaagatcgctgacgcattgagatcatgcagtttgtccgcaatctcagcggcatgctgatcaggcgcgtcatcgatcgttaccaatgcgatcggttttttctctttctgttcatccattttttccacagaaaaggttttcggattgatatagtaacggggctccgccttctgttttttctcttttgtatgatggttttcccgtttggcatgattggccgcggcttgagaatggggtttgtttgtttgcatcttttcatttgattggcagccggcgagtaagcacatacatatgacggctgcaatggctttatacatgcaatccctcctgatatggttttgcccccagtataacgaaaaaacagcgctctcacgaaaaacaatgtgccttttttacacatcggctgtgcaagttgtcacacgtattatttcttcattaaaaacggtttcaattatataacaattcagtaacaagccttaggtttttcacctctcgtgatacacttaatatagtccttataaatggatgaaccaatatattatataaaacagaggagtaagatagatgcgctaccgtacggtgattcccttttttttgatgctgttcgttctgtcaagctgttcggtttctactgtcattccattcaaaaataaccggatcgacagcattcatcacactcaaatcttgtttttttccgatgaaaatcatatagataaagaagttccttattacgatgcgattcttgatttagaaaagaaatatccccatcatgtcgatcaaatgaaggtttatgacaacagaaagggatgggaagaggaaatcaacacgttccctgcgctgatggtgatcaatcatcggcatgtggtcatgaagattgagggatccgtaaagaaaaaagaggatatcatcaaacctatgcagcatgtgcttgcacaataaaaacagcccccgcttttacaaacgggggctgtttctttgttacatcattattttacgatgtggatcgggcttccgattgctacttcggcagcttccatagtgatttcgcccaatgtcgggtgagcgtgaattgtcattgcgatatcttcagcagtcattccgccttcgatcgccaggctcaattcagaaatcatgtcagaagcgcttgcgccggcaatttgcgcaccgattacaagaccgtcttctttacgggtgatcagcttcatgaagccgtcagtttcgttaagagacagcgcacgtccgtttgctgcaaacgggaacttagctgcaacgacttcaatgccttcttctttcgcctgtgcttcagtgtaaccgacagaagccagttcaggctcagagaatacaaccgccggaataccgaggtaatcgatttcagccggctctcctgaaatagcttccgcagcgattttaccttcgtaagacgctttgtgagccaaaggaggtccgtcaatgatgtcaccgattgcgtaaatgttcggtacgtttgtgcggcactgcttgtctgttttaatgacaccgcggtcagtcatttcgataccgacttgctcaaggccgagctcatcagtgttcggacggcgtccgacagtgattaatacgtaatcagcatcaaccgttttttcttcgccttttacttcgaatgtaactgttacgccgtcaggtctttcctcaacgcctttagccatggcgcttgtatggatttcaacgttgccttttttcttcagtctgcgggtaacgagagaactcatttgtttttcgaagccaggaagaatttcatctccgccttctaaaataaccaattcagttccgaagttcgcatacgctgttccaagctcagtaccgatatatccgccgccgataacaacgagctttttcggaatttctttaagcgccagtgcgcctgtagagttcagaacgcgttcgctatatttgaagtttggcaattcgataggacgagaaccggtagcaatgatcgcgtttttaaatgtgtatgtttgcgcagagttctcatccattacgcggacagagttgctgtctacgaaataagcttccccgtttacaacgtccactttatttccttttaaaagacctgcaacaccgccggtaagcttatttacaacagaagctttccattcttggacttttgtaaagtcaaccgttacgttctcagcagtgattcccatgtcatctgaatgttttgcattctcgtaacgatggcctgcattgatgagcgcttttgaaggaatacagccgacgttcagacaaacgcctccaagagttgctttttcaacgactgttactttttgtccaagctgagcagcgcggatggcagctacatagccgccgggtcccgcaccaatcacaagagtatctgtttcaatagggaaatctcctactaccataacattacgcctccattaaaataagttgtggatcgttcagtaaacgcttgatgtggtttaacgcattttgtgcagttgctccgtcaatcatacggtggtcaaagctgagagaaagagctaagacaggagcagctacaatttcaccgtcacggacgatcgctttttcagcaatacggccgataccgagaatcgcaacctctgggtggttgataaccggtgtgaaccattggcctccggcagaaccgatatttgtgatcgtgcaagaagcgcctttcatttccgcaggtgcaagcttgccttcacgcgcttttgtagcaaggctgttgatttcatcagagatttcgaaaacggctttacggtcggcatttttcactaccggcacaagcaggcctttttcggtatccgctgcaattccgatgttgaagtaatgtttttggatcacttcatctgttttatcatcaatcgatgtgtttaaaacagggaattttttcaaagcggatgttaatgctttgacgacgtaaggcagataagtcagcttgatgccttgatcagcagcaacttgtttgaactgtttacggtgagcaacaagatttgttacgtcaacttcatccataagagttacgtgcggtgcagtatgcttagagttcaccattgctttcgcaatcgctttacggataccgctcattttttcgcgtgtttcagggaattcgccttcaggagcctgagctgctgcaggtttagctgtttcctgaggtgcagctgtttcttgcggtcccgcttcttgagccgctcctccatttgcaaagctgtcgatatcttcttttacaacacgtccgttattgcctgaacctgttactttacggatatccacgcctttttcacgggcatatttgcgtacggaaggcatcgcgatcacgcgtttgttcggatcagcttccgcttggtcctgctgtcctgcgccggtttcttttgcaggctctttaggagtctcttctttagagatatcctgccctgcttcagcagacgactgaacttgagcctcagttttcgcctctcctgaatcatggcttcctttaaattgaagatcttcgtaaccaggtgcgtcaaacgtaataatcgtttgtccaacagttgcaactgttccctcttcaacttttaattctaatacttttcctttaacaggtgaaggaatttctaccactgctttatcattttgcacttcagccagaacatcgtcttcttctacctcgtcgttcggcttcacaaaccattttacgatttcgccttcgtggataccttccccgatatccggaagtttaaattcaaatgccacagttttcgacctcctagttgattaagcaaattttagttatgcatacgcaagcattgaacctagtaaacagactccttcatcataagagaaaaggactctctttaccgtcttttaagatgcctgattaaaattcaagaacttttttcgcagtttcaagaacgtctttatggtttggaagccatacgctctcagcaagcgagaaaggaaatactgtatcaggcgccgcaacacgcagaaccggagcttccaggctcagaatcgcgcggtcattgatttcagctacaacgttggcagcgatgccggcttgtttttgagcttcctgcacgacaattgcgcggcctgttttttcaacagaagcaataatcgtatcaatatcaagcggacttacagtgcgaaggtcgataacttcagcagaaacgccttctttttcaagctcttcagcagccttaagcgactcatgaaccatcgcgccgtatgtgatgatagaaaggtcagtaccttcgcgtttcacatcagctttgccaagctcgattgtgtattcctcttcaggaacttcctgacggaaagaacggtaaagtttcatatgctctaagaaaacaaccggatcattgtctctgatagaggcaatcagcagtccttttgcatcgtaaggagtggaagggataacaactttaatacccggctgctgagcgataaggccttccaaactgtcagcgtgaagttcaggtgtatgaacccctccgccgaatggagaacggattgtcaccggagaagtccagcgtccgccggaacggtagcggagacgagccatttgtcctgagattgaatccattacttcatatacaaatccgaagaactggatttccataacaggacggtaatcttgcaggcctaaaccgagagcgagaccgccgataccggattcagcaagcggcgtgtcaaatacgcggtcctcaccgaattctttttgaaggccttcagttgcacggaatacgcctccggcaacgcctacatcttccccgaaaagcagaacgttttcattgtttttcagttctgtgcgtaacgcatcagtgatcgcttgaatcattgtcatttgcgccatggcttacttcgactccttcgctttgtaaatttcaagttgttctttcaagttgaacgtcggctcttcaaacatattctcaatcagctctgttactttcggttttgattcgccgtcagcctttttgatagcttgtttgatttcttctttggcctgttcaatcactttgttctcttcttcttcagaccatagtcctttgttttccaagaacttgcggaaacgtacgagcgggtctttttgctcccattcattttctatttctttcgtacggtatttagtcggatcgtcaccggacattgtatgaggtccgtaacggaatgtaagagtttcaatcagagtcggaccttcaccgttaattgcgcgctggcgtgcttctgcggttgcagcgtaaacggctagtgcgtccattccgtctacttgaacacctgtaataccgacggcaactgctttttgggcaattgtctgtgcggatgattgcttttctacaggagttgaaatcgcatagcggttattctgaacaacgaagatcgccggcgctttaaatgctccggcaaagttcattccttcatagaagtcaccttgagaagctccgccgtcaccagtgtaagtaatagctaccgcttttttaccgcgctttttaagccctaaagctacacctgcggtttgaataatttgagcaccaataataatttgaggtgataaagcgtttactccctcaggcatctgattacctttaaaatggcctcttgagaacaggaatgcctgatgtaaaggaagcccgtgccaaatcagctgaggaacgtcacgataacccggaaggataaagtcgtcctgttcaagcgcgaagtgtgatgcaatttgagaagcttcctggcccgctgtcggtgcatagaaacctaaacgtccttgacgggaaagagaaattgaacgctggtctaaaatgcggatatacaccattcttctcattaattcctttaactgatcatctgaaagatcaggcattgcgtctttatttacgacttctccttcagcatttaaaatttggaacgtttcaaactgcttattaatagcatcaaattgttttttgctatcaacaattgaagtttttgtctttgcagccattttttaaaccacctcttcttttgatttaacagggttaggataccgtttagccatccgtattaaaaacagtcttatcatgctctgcaattctaaaattaatcattcagaaattcacatagcgcttaagcaaagataatgacgtttaaactgtactaataaaaaaagattttttattagtacaatatgatcaacaaccatagtttacagtaattaaacaaagccgtcaattatttataaccttattttgaaaccgcttataaaacttaagatcatactgcgccaaactgtactataaaagactttaaactgtattataaaaacgctctactgtactataattaaaaaaaattacaaagagtaaattaagttatttaacttcgagggcaggctttgagaaggtgccgcgggataaaaacgggcagttagcaatcgtcccgcctgccgaacaggcgggacgatgcttttgtctaattattcaatacccgcccacacgatattcagcggcgtcagtacggcatgaggatgaaactcggaaatcggagtgaaaaatacatacgtaaaatcttcggctggatcagaaaacatgccgcaccaacccattccaagatgtgagaacgtgccttctgtcatgaaataatggtcaccggccggccacaaattaatgcctaaaccaaagccgccctcctctcttggcgctccgaagaagtaaaaaggaagaccgggctttatttgatttctcagcatggcctcgactgtttttcttccaagcagcttcttatctttcaatctgcctttatttctaaacatttcagctaacttccaaatatcttccaatgaagagtacagaccgcttgtcgctttattcggaaaatacgggtgatgacttttttccagctgtacgcactcgtgctcattgatcacacaaacttcttcttttaaagcatcaggcacataaaaaaacgttctttctaatccgagcgcttcaataatatgctttgttacatactgttcgtaggacatgcctgttactttggaaataatgatgccaagtatgacaaagccggttctggaatagttccatgcttcatccactccgtactctaaaggcgtactgaccagatagcttatccattcttcctcattcgttaagtcaatgccttcagccttttgaatatccagctcaaaacttaatcccgccgtatgagtcaaaaggtgtaaaattttaatgtctccgaaacccggtttatcaaatgcaggcaaaatgagcttgaccggcattttcagatcgagcagacctttttcgacgagctgcatgacggctgcagcggtaaacacttttgtcaaagaaccgatttctctgattgtatcaagctgaaatgtttgcttttctttttgtccgccggtaaattcccctaacgactcagccgcaaaaacctcgcctcctcttgatatcatataactcgcgcattgcagatctccattgtctatcatcgtctgataatggctgttaagagcgttaatttgtttcatatcaaatgccggattgcttattgtttgtttcattgttttctccccctgtactgtatgtatcgttttcatcccttacttactgatttcttgatgaattctgacaccgctttattaaattcttccgggtgtgtgatgttcggaagatgccccgctcccttaattttctttaattctgcattgctcagcagtttcttcagcctttttgtttctttctgatcaactacgctttccttctctcccgtaaggataagcgttcttgtataaatgtcttttaaaaagccgatcgtagaatagccttcttgttgatgtatcttcataaaacgttcaatagaagcatttaagaattgattcctgtataaactttcatattcatgcgattttcctatagctataaaatcatttttcagtttttcctcaacactgctttcagggtcttcttcgtattcggtgtaacttccggaaagaatgagtgtttttactttttcagggtattcataggctatcctctgtcctatcatgcctccccaagaagctgccgcaatgtggatcggccaagcaacccctatctcgttcagcacttcaataaaagtctgagccagcccgctcagtgtaaaatcggcgctcccctcactcagcccgtaacccggtgtgtgtatgacaattacattaaattggtctgcccactccttcatttgttctttccacatgtaagcagtggtagcaaaaccgcaaatcagtaaaattgtttcacccttaccgctcatcaatatttccatatgccgggcattttctgtgttagccagaaaatgaacggtttccgtttcttctgtctggtaaaaagcgatgagtttttttgcggcatcgctttgatcgtgctgaagggctcctttcttcagtctgctccaataatgcaaataatcgtctagatgacgattggaagctgtgccgagtattcggaaaggactttcagcttcttcttccgtaacgattgacgaagcatcaaaatcggctgcaatcgctgaatctcttaccagaggcggtgctgaacgggcggataacggattgaaattattttgtattttttctttttctccgtataacacgatcagctggtggccttggccgagaagcgagtgttcaaaagctttgattccggcagtattttctaatgggtgaagtccgtactcggttttcataatgtcttgaatgccggcatcaactgacatgcctccgtctttccagaaaggccaatttacagcgatggtttttcctgatctccccccctcctttctcatacattccctccactcggcaaaatgctccagaaaacgattggcgtaggcgtaatcagcttgacccaaacttccgatttctgaagagatggaagaaaacaaaacaaaaaagtctaaaggcatatttctgagcgcttcatccaaatgaatcacaccattgacctttgattgcagcaccgcctgagcttccgcgtctgttttattcataatgaaagagtcttttaacacgcctgcactgtaaatgaccccgttgatttcggaataatcagcatgaattttttccgctaaattgatgacctgctgtttatctgacatgtcagcctggatgtaagaaatgtttgccccgtcatatcggatgctgtctaatttttcttccatttctgctgtcattttcgatcgtccggcaatgataacgctggctccgtgatttgcataaataaacgctgaaataatccagccgatgccgcttaaccctccgattatgagatacactccgttttttacaaactttgcggccttttgccctggttgcagcgaagcatctttgtatgctgtcacccgccttttttgatcgccgtcatatttcacagcctcatgatgtccggcacttaattcattgagaagcaaagatgctttttcaatggtttgtcttgaagaaatctcaaccgttttacactttatattcggctgctccgcattaagcgttttaaaaaagcctccaatcgcggcgtaaatcggatttgtatattgatccttgtcatgtacgtacaaaaggttgatgttatcttttattttttgacggatcaacgctttacttaaataaaggattgaataaaagctgtgagtcaaatctaacgctgcctcagtataagcttgttttgacaggtaatgaatgattgacgccggaaacgctccggactttttcatatcatctaacagtctggtgtaatgagcagactgctccggattaaatttataatgcttttcatttaccatttcatattcagcggcggcttccgcataaataacattttcactgccgatgtactttcggatttcatcactcaatgaactgccgaaatcgaaaatcaatgtattttccttaggcacttctccggactttaatggcgattctatccattctttttgtaaatataaagattcaagcatcggcttttcagacggctctttcgtttgcgttttttctttaaaagctgcggccggcgtattacgcacatcatatttttcttctaaataagctgctaaatcatgaatattgttataatcaaaaagcaatgtcggatacaattgtgtatccaatctttcctcgagcattttcgatatatgcagcagctgttttgagtcaagacccagttcgtaaaaagattggtgtttgtccgctttatttggcggcgtgtttgtcacatctccaataatggatgacagctcatctgttaatgttttttgactgtcttggtgctgaactgtatcagagatagagtctgtaacgcgagctccgtatttctcctgcagatattccgtcaattcaccgattgtggagtaatcaaataataaagtcgggtacagctttgaacctaacaacagttctaattttttagataagtctaataactgtttagaatccaagcccatctcgtaaaaggaaatatcattcttcaccgtttcagcaggcttttcaatcatgccggctatctcttggattaaattatttctgatcatttctttattgttcgttacgctgccgacgtctttagctttttgggaatgctccagcctttgtattgatttttcatttctgactcttttcacaccgaatcgctcataataaaaagcaagctctccatcaggcctgtatacttctatgtccgcatataaaatgtctttagaaggcggctgcgttatactgtttttatcaatatacacaaaacaagacccggttgttttatgcagtgcccggaatgtctcaatatatatagggataaacgcatttgttccttcatccggcaagtctgatgtaaggactcccaacaggctgagagatccatccaaaaatgcggggtgcatgtaaaagtcatctgtatattcttttgaaagtccgcttaaactgacctctcccagaatataattttcaccttcatataccgtaccttccaatttcataaaatctttatgaatcaggccgcccctgcgcaaattacgataggcggcttcagcattcgaagtccggacggcccctttctttaatgcttcgattgaaattgtcttttcgtctatcgcattttttcttatgatttccgcctgcaagttgactgacgcttcaccttccgccttttcagcgacccatttcctgcttgttgtttcaacaagccagccgttttcttgttccgtaaactggaaggtgacttttttatcaaaatggactgacgtcgcaacaggttcacggaataaaacatgtttgatttcaaaacttcggggtgatatccctttctcagctaaaaatcgtgttattaaatccagatacgttacgccgggtatcgtacgcacttgatgaaggacatggtctgaaacaatataatcgtcatgtttgactaatacgctgaacctcatgcaactcgacaacctttcttcttttacaaagtaaagaaacagagcaggtgctactctgtttcatcaataatttcaagaagccgttttttattctgtttgatttgtttttttcgatttgaatccggccagtactcttttctgacaaactcggcaggcggcagcggagttctgacggaatgatatgaatcatccaggccgcttaccaaaaggtgggcgtttgttccgccgaaaccgaaagcgctgatgcccgccctccgttttccatccttccagcttctcagttctgtattcggataaaaaggcgacttttcaaattcaaagcggggatttggcgtttcacaattcaatgtaggcggaatttccttatgccatattgataaaatcactttaatgaaacttgccgctccggcggcgcttaataagtgtccgatattggtttttacacttcctactccgcaaaattgcgttttgtttgtgtctcttcggaatacttttgtcagagcctgaagctcaatcggatctccaatcatcgtgcctgtgccgtgagtttcgacgtagctgactgatccgggagtgatatcggctctttcaaatgcatcttgaataacctgctcttgaagcttaggattcggagtcgtaatccccattgtcgcaccgtcgttattaatagctgatgcttcaatgataccgtatatccgatttccgtcagcttttgctttctccagcggttttaaaagaacagcgccaaaaccctctccgggtacaaagccgtttgccctttcatcaaaagtaaaacactgaccgtccggcgaaagagctcctccttctgttaacatcaggtaaggaatttcatccaaaagcagatccgcccctcctgccagcgccatttctgaatcaccgttttttatgctttggcaggctaaatgaatgctgactaatgaagaagaacaagcggtatcagacaccatgcttggaccgtgaaaattaaagaaatgcgacacatgtgaagcaataaagttttgactaagcccgacgatgtggctgctgctttctttcggcagtttgtgaccgtagccgcccattctggaaccgacaaatacgccgactttttttcccgataattctgtttcttcataaccggcatcacgtacagtctgtacactcgtttctaagaaatgtcttatcagcggatccgtttggatggctttctcctcttccatacggaaatactccggatcgaagctgccgattccattaataaatcctccccatttgctgatgctttttcccttttgctgcaccggagagtaatgttcttctatattccaccgggaatcaggtacttctttaatatgattcttcccttttctcagattgtcccaaaattcctctttatcagccgcgcccggaaacttacatccgattccgataacagctatctttgcagtggaagccgtctgcggttctgtatttcggctcgtcacagactgcatatcatgctgattgctgctttgagaatcagtctgttcgatttgttttttcaacggcggcgccgtcttaccgatatattccgcgagaccatgaatcgtgttgtgttcaagaagcacagtagggtcgatttttttctgaatcattgcttctatacgatgtataatgctgacaagaagtatagaatccacaccgtattcctgaaaatccgtatttgggttaagcttttcaaggggtatgctcaattcctcggcaaatacggcagaaagttcactgacaagcccttctgaatgatcaaaagtgccgggagtctcctgtcttcgggccggaaatgaagtcttgccggttttattgatgttcaggagactgtctgcatgaaacactgttccttttttcacgataggaatgatattggccgattttttctccagtgcatgatacaaaatcgccagtccttcccgcgtggatagagagtccaatcccaattcatcatataaaggactcgtcacagtacccattccgacttctttccagctcggccaattgatggacgtgaaatacgttctccccttttgaaaatgataagccgcgaaatagtccatatatgcatttgcagacgcgtaatcagtcattcctttcgacagtttgggtgactgtgctgcaattgatgaaaacagaataaagaaatccagcggcctattattaaaaatccgctccaaattctgaagtccagtgactttcggcccgtacaccgtcttaaattcactcattcttttatgaataaaggccggatttccgccgctgtgcagtccggcacagtgtatgacaccgctaatatctttaaattcaaggcttacttggtgaaagaatgaacgaagcttctcttcatttgtgagagaaccgctgtaatacagatagtcgacacctttttcttcaaaactttgaaacagttttatattgctgactgtcttttcgtcctgtctgccctctttcagcaaatgatcccattcacttcgcaaaggtaatggacgcgtacccgtcagcacgagttttttcactccccgtttcaccaaatcttcagctattgctctgccaatgccccctgtcccgccggtaatgacgatggctttatccgcaggaaatgaaacaggaccgccgccggtatcgattctttcttcttcaaaatacggaacatatctgacgccgctgcggtagcatacttcattctctcctgtacattgcgccctttcaatctcaaagatttgtttcagcttatgcgtttctttcatgctgtctatatctattgttttcacatgaacaaagccgtattccgcagaaagggctttcagaaaagcagctgattctgcacccgtcagctttggtttttccgctttaaatacctgcaagccattggttagttgtaaaatggataatggtgtttccttttttctccgcttaattatttcttgtataaataagaatttaccatatgggatgccgttctgattttcactctggtttccgatatctgagaaatcaaatatattttcgacctgccgctcaccgcccgagaagatctcacagataacgtcgtatgcgtggttttcatctaataaagaacactcaaacatttgatcagagtgttttatatatgaagagtgatgttttatgacaatcagattctcctgatctatatccggacaaatggtgcgggcaattgattctgtgtcttgattcacaaatgcgactgtcagtccgtactcttttgtttcggatggatttacaaacggattctccctccattttttttgcaagtgatgttgagaagaatgctgagggatctctgtcctctcagtcctggacggaacccaataacgttcttttgcaaacggataagtcggaattgagatccgtttacccggctgctgtaaatgttgatgaacggatttccagtcgatatccgccccccaaacccataattgagccagcttttccgcttcaccgttctcaataatggtctttacaaacaattcgcctgctctgccttccgttaacgccttcattttttcagcaaatgcatctgattgctgattaacatatacgcctggaacttgcttgtcaccgcggcaaaactgagataatttatctttcatttctttaagagaggtaccggtaatcgccgctctggcctccatcgcttctctgcccgattgtgtagtgtatgccagatcccgtaaaacgacgctttccgattggccgccttccatcacttcattcgggaacatgtctcttatcgctccggcatattccttcagtaagtattcagtaaccgcttgaatggaggggcaatccgttaattcatacatcgtgagttcaatatgaaacatttcgttaataaaatccgccatccggcttaattccaaaggccctacgccaaattcactcaggtgatcagaaatattaatttcttccggatggatatgaagcaattccgaaacaaacggtttgagtacttcattcaccttttctttcatatcagtctgtttatcctttacttcaggacttagtgaacgctgaataaaatctttcatgttttcggcatactcaagaagacgttcattgtctttggcagataacaggacaatatgcggttcgttctcaacatgttctgttgagacgtttgtttcttcatattcttctataatgatatgaacattcgttcctcccgctccgaatgagctgattcccgctcttctcggaacagttactgtttttccgttttcctgcagtttcggtttcttccagtcttgcaatgaccgctgtacataaaagggagatgctttaaaatcaatatttggattcaacgtctccgcatgtatggaaggaaacagttttttcagtttcatttgcaaaagaacctttgtcaaaccggcaattcccgctgcggcctcaagatgaccgatatttgatttgacagaaccgattgaacaatattgagtgtgctccgtaaattcccgaaacgcttttgttaatccggtgatctcaatcgggtctcccagagcagttcccgttccgtgagcttcaatataactaattgtacgagggtcaatacaagctttctgaagcgcgtcctgtatcagttcagactgaccatttggattaggaaccgtaaaaccgtttgttctccctccgtgattgaccgctgtcgctttaatcagcgcataaatatgatctccgtcccttaccgcttccgccgccggctttaaaagtacggagcccactccttctcccggtacataaccgtcaccgccctcgccgaatgtacggcatcggccatcacttgcaaagaagcggctttgatttaataatgtatatttattcggatgaagtgtaagattgactccgcccgcaacagcaagtgtgctttctcctcttcgtatactttcacaggctaagtgaatggcgttaagagaggatgaacacattgtatccaccgccatactcggccccttaaaattaaagaaatacgatattctgtttgctattgcagaaaatggagacccgacggccagttcatttcctttaagtgattcttcaacgccgaaaaattgatagcttccatatgtgacgcctgcaaatactccgacctttttgcgggtcagatctgaaggtttataacccgcatcctctatggtattgtacactgtctctaaaaagagacgttcctgaggatcaagaaaagcagcttctttcggtgatatccggaaaaataaaggatcaaaccggtctggatttttcagaaaacctccccacttatagcagcttccctcgagcatttccttccggtcatcaggaatttcgcttacgcaatcccgtccattcatcagcacattctggaactctctgatgttttccgcacccggatatctgccgctgacaccgataatggctatatcagcagaaaggggatcggccgcaatgtgctcttttgaaccttctccttcagagcgtgccggcgcttttgtttccactggttttcttttttgctttttttgatatgaaacaagttcagatttgccggccgggttcagcagtttcatcattcgttcgctgtgatgactcaggaaatattcggctaactgcgatatggaatgatattcaaaaaataatgttttcgacaatctgccgatactttgctccagctttttggtcaggcgcatgatcatcactgaatcaatgccgtatttctccaggtattgtttttcatctatgagtgagaccggtaatttcaattcctctgacattatattttttagataactgatgatattttgtcttaattcatcgctttgtaaatcggcatcttcctgccggtctgaatgtaagctgattgtgccggcacgcttcagcacatcctcaatcttttcttttcggcctttcagggcgatcagctgttcagatgattgacacaagctgttctccagagcctgtattccgtcaccgtcatctagcgggtcaaggccgagttcctgtttcatgtaggatattccttcatcgtcaatattcatcccgccggaagtccatagcggccaattgactgacaccaccctttcggcagactcttttgcggtcataactgctgcatactgatccaaaaaggcattggcgaaagcatagtcacattggccggctgatccgaagactgccgatgtggatgaaaacaagacaagtaattcaactttcatttttttgatttcttccgccagccagagcgcgccataaactttcgaacttgtgacttgatcgatttcttcttttgtctttcttaagataaaagagtcacggagtacgccggcactgtgaaatactccatgtaaggtgccgaactgctcttttgcaaaagcaaacatccgttcagcatcactttgttttgaaacatcagatcggatatattcaactgttgaacctgaacttcttaaatattcgatcttttttttctgctcttcagttaaatcagagcgccctgtcaatatgagattcgctttccatttttccgacagatgttttgccagtatataaccgagaccgcccaggcctcctgtaatcagataattttcatgatgtttcagcggctgggttaaatcgaataagccggctttattatagcttttcgtaaaacgtctgccgttttcatagcgcacttcaaaatggatatcccgtttttcgtcacactctctctgatatatatcagctattgctggaagagcggctcccgcaccctctgattgagtgatattgataatctgatagtgaaaattggggtgttcctggtgaacggttttcaccaatccgccgagagcatgatgcagcggcagttgttctttattctgagtttgaaaaatatgcgtcagttttattatctttttccattttaattcaatcagcgcctgtgtaatatacagaagagaaaacaatccgttttccaattgtttctgtatacctcccttactcatgtcagcctgagaatcagaccacaagtgaagaatcttttcgggcggctgataatgatcatgaatgtatcggaacagctttagataatcgtcttttttcacgtggttcatacaaatcgtatcatcatgtaaaacagcaaattcttctccgcggatgacaaacaagagagtgcagtccttaaacaaaccgctcaattcttgtatttgccgttcattttctgcaaaaatcaggagcaatcccgtcaagggtacgctcttcgtactcggaatgaacgattctgtccattccggcttgtaatataaaagaggatggttcgatgcccgtgatttttgattctgaatggatgttacacgggcatagccttcgtcagccgacatttgtcctgtttgaatcagatcaagaatatcgctgatttgttcacgttttccgttcatcattcttcccccattaattgtttcaatacagccttctgatcaatatcattggtttccaattgacgcaggagacgaatgagttcatcgtccgtctgaacagtgtctttttcatgaccatatctgaatctcacatctctgcactccgccagaatgcttccgtttccatctgtaaatgtcatatgacacgttacatcacggctgttctgccggttcactttttgagtataaacataaaaattttgagcgagaggctgatagacatccgccgctcccattccgatcaattccgggaaggtttctccgctgacaaaaaatgcactggcttgaatcgcggactcaagcgcttcaggagaaatcgtaaaattttctctttttgcataaagctcatccggcattgaatgaagcgacagcattccgtaactgtttttcgctgattcaatgacaaaaggcgcttcagccggatgttcagtcatttctgatttgacttcagcaatatcaagcgcttcaggaagcataccgctttcaggcttaaccatatgcgcatttccgctggcaagacgtactttattctcattttttgtgtttgcatatatgtcaaaccgcgcaaagtcacgctcaggcgtcagcgtaatcatcagttcccgtatatctgtcattccgttcatgctttcggtccacaataaatcggtcaatgtttgaactggttgtccaaatgccgccgctgcattgacgatagccatttcagccaaagatgcataagggaaaaaggacacgtttccttcagacagacttagtgcgaacggatgattacggctgatttttttcgtgaaactgaactgatgaaaatcggacgtgttactccccaagaaagggtggcccgtcttactcacatccgctgaaacaagtgcttcccctttttccgctatccaataccgctgtttgatcagcggttgtcccgggatagaaatcctgcgggcattccgattcacctcaaaagtctcccaatctatctttcttccatttacccatttggatgctgcttcggcgtaatctgaacaaacgtgaggcatttcattgtgaacttctgattcgaatgtattaccggtatggctcaggctgcttttttcacccctgatataagctgaaagctcttcagcaatgacctgcccggaatctgccactatcgccagccgttcttccatatgatcgcgtcccgtctgaagtgtataggcaatatcctgaagacgcagtttatgattgttatccttcgattcattttctgatagaaaatcagccataacctttgcatattttatcagccgttgtttgtcttgagccgataaaacaaagatcactcggccgctttgatgatcaaatgcttttggcggttcatacgcttccaatataagatgcgcgtttgttcctcctgccccaaaagcgcttaccccggctctcaaaggatgaacagcatggctgttttgcggaatattccattcagccgctttccgctgcacttgaaaaggaacctgatcaaaatctataaacggattaacaatatcggaatgcagagaaggaacaagctgcttattcttcatttggagaagcactttcgttaccgcagcgattcctgccgcagattctaaatgtccgatattggatttcaccgaaccgatggcgcaaggatggttcaattgataggaatctttcagtccttgaatttcaatcggatcgcctaatgatgtccctgttccatgcgcttcaatataattgacggtgttcggatcaatgtcagctttacgaagcgcttctgaaatgacctccgcctgcgcatccggattcggtatggaatacccgctcgtctttcctccatggttaacggcgcttcccttaatcacgccgtatatttgatcttgatcttctattgcttttttcaatggttttaacaatacggctccgactccctcaccgggaacgtaaccgcttccgtcttttccaaaactccggcatctgccgtcacttgatagaaactgtcccatgctgaggaacttatatttattcggatgtattgacaaattcactccgccggctaatgccatatcgctctctccgcaatgtatgctttggcatgcgtaatgaatagaggtcaatgatgaagagcacattgtatccagagccaaactcggaccttttaaatgaaaataataagacacccgattggcaattgaagaatagacggaagccggcgaaaaagccgctccattttcttctccttcaaatagttgatattggccccacattgcaccgacaaatacaccgactttcatcttttccagcatgtttctcgggtaccctgagtcttcaaaacaatttttggccgtttctaaaaagagtctttcctggggatccataagttctgcttcccttggggaaatatgaaagaaaagcggatcaaattgatcggctccgctgataaaacctccccacttgctgtaagacttccctttcatatctctgtcttcgctgaagaaatcatctatattccagcggtcaggcgggatttctgtaatacaatcttttccgctctttaaattctcccaaaattcaggtaagtcttcagccatcggatactttccgcttaaaccgataatggcaatgtcttgatgccttgtatcagctgtttcatttatttggatctcacggctttcatcctccttgaaggtatcttgaagtgcagattccaatttttctttgtcaccttcaaacacgatcagctgtgatgcgttcatagagagtgaatcttgaaaagctttgatcccattggttttactaaggggaaccataccgattttttgtttcatccatttttcagtttgtttatccactttcatgccgccgtcttcccataggggccagccgatggctactgagacgccggagcgttcttttttccgcctcattccttcacgccactcagcaaaaagatcgatgaaccggttagccaatgcataatccgtctgtccgatattcccgtacatcgagctgcttgatgaaaacatcacaaagaagtccaaaggttcggtttgcagcaagctgtccaataagaccgtcccatttattttcggagcgatcacttcctgaatttcatcttttgatttttgaatcaataaagcgtcgtgcgtcacaccggcactgtgtatcacaccgttgatttctccgaatttccttttaatagtttttatgattcgctctgcatcgcggctatctgaaaaatctcctcttatatattgaacggaagaaccgcctgctttcattcggctgattttgttctttttgtcttccgtcagttcagaacggcccgctaaaataatattggctttcgtttgcgctgcgatatgttctgcaaatataaggcctaagccgccggcccctcctgtaatcatgtatactccgttttctttaaaggagaaatctgagttttgagccggttctgcttcccgtaaggcacggacccagcgcacatttccttcataataaagatcggtttctcccggatgcgcttcagttgattcgcatctgatgatttcagctgtaagagccggcaacgatgtcttgtctgaaactgatatcccgattgtcttaagggccagtttcgggttctcaagcaaaatagactgccctgcgccatggactgaagcgtaaagcggctgatcatttttatggtccgccggataaaggaaaagcgatacaacctttttttccgccttgctgcgcatcaatgcccggctgaaaaagaatagcgggtaagcccctttagaaagctgttcacttattttttccgggccggcaaatgatccttccggccacccgtacaccacggtgtcgggcatttgccccctttttttcagatcagctgcaagcctgtcaaagtgggcttcctccctgtgatctatctcataaattccgtctccgtgataggagaaacgattccctgataaaacgagaatgatctgtgtattttcgaatccattttcagcattttcccgcataaaatgaaaaagctctctgtcatattgaaacagcagacatgttcttttctttttatttccgcaatgcgggtcccaagcggcagccttttgtctccaatacggcgttaaataggtcagagccgtatgattctctccatgatgtagagggaggtctttgtcaacggaagtcttttcgccgctctccgcaaaataatttgcaagtttttgaatcgtcggatactcaaacaataaagtagggtacagttccctgcctgttttctcctccaatgcctttacggcttgcataagtgtgacggaatccaggccttgttcataaaaaccttttaccacagagagtgtttcaggggcagtccctttgatgtctgcgatcagctgctgaatgtctccttctgttataagagcggaaagattttcgttcttactttctttcatgtcaggcttttcagccggttgattttgcgttaagaaataactggacattttttgattttctttaatatacgcggcgagttcccggatcgttttctgctcaaacaggagtgtaggatacagctgttcccctgttttgttttcaagttctttgacaatggcaagcaaagaagcggaatccaggccttgttcataaaaaccaatgtctgtccttatgtcacgcagatctatatttgaaaccccggatattaattctttaaggtgtgtctcaatgctttcgcttcgatctatgattgaatcttttctcatcaggccgtcttttggctgagaagccgcttcagtttctaaacgagtctgcttcagattttcaattaaatcttttgagcgaatatgtttcacagacagccgtgtaaaataagcgatcatctccccgtgtgcatcgtacaaaccgtaactgacttggatgacatcccctgaatcatgattttggtcttgcttctctatgtacacataacacctgtcttccaggcgcttcgtcatacggaaagattcaatatgaatgggaatatacgttttcatccggcttgccggagatccttgtgtaaaatattcgggacatgcctgataaaggatcgatatgatggtagacgcatcaagaaaagtgggatgcaattgaaaatagccggtatattgtttggcaatttggctgagcgacaactctgcaagtacagaatgatcagacgcataaaccttccccagactcttcataaattcaaaatgctctatatcaaccttttttaaatagtcatagcatatctccatatcggcttcacggacggaggcatgtttgatttcatcgatatgaattgaactcatgctttccgggaatttctgcatgagcctgcagttcatattctcatcccagctttcatccagaatccggtcatcttttacctttctgctcttcgcctggatttcccatccctgttccaatccctgaaaacggatgcggatttctctgtcaaaggtgtccgatgttgctacaggttccaaatacaaaatattctgacactcgagttcttcaataggcaaacctttactcagcgccatacggtatatcatatctaaaaatgtgacaccgggtataatccgggtgccatgcacccggtgatccctgacaatatagtccgtatgtttaattgttaatgtgaactgatagttttgattactggccacctgtctcattccttttcttttctttataattctttgaaatcaagtaaaggaatcagcaattctgactcttccttttctggagcttctccattgtcgatccagcattgttccttattgaatataaccggagaaagcgggtgtctttttgtctctccatatcctaacgtgagatggctgtcgctcaatatcatatgtgcgttcgtgcccccgaatccaaaagaactgattccggctctcaaaatcccttttctgggacgccattcttttaaagacgtgttcggaaagaaaggcgactgatcaaatttaaaacgcggatttggcgttttacaatgtagtgtcggcgggagcatctgattttttatggataaggcaacctttataatactcgctatccccgctgcgctcattaaatgtccgaaattcgtttttacgctgcctactccgcaaaattgcgtttcttccgtaacctcccggaacacttcagtcagcgcttttaattcaatcggatctcctatcatcgtaccggtgccatgcgtttcgacataactgagagtatctgcatctattccgccttttttcagggctttttttatcactgcgctttgcgctttcggattaggtgttgtcatccccattgtctgtccgtcattattaaccgcggaggagtcaattaccgcgtaaattctgtcaccttcggcaagggcgtcatcaagtcttttcaaaaggactgcgccgcatccttctcccggtacaaatccatctgccttctcatcaaatgtatgacattttccttcaggtgaaagcgcccgagcctcactcagcatgacgtaaggcttttgatccagcaaaatgtcaaccccgcccgcaattgccatatctgactcttttgacatcaggctttgacaagcgagatggacgctgaccaatgaagaagaacaagccgtgtctacaaccagattcggtcctttcagattaaaaaagtgtgagatatgcgcgcctatgaaattttgtcctatacccacgatcgtattttttgaaggggaacctattttggacataaacgtcccggtgcgcgaaccgatgaaaacgccgacttctttgtttgatacttcttcctttgtatagccgccgtctctcaatgtctggacgctgacctcaaggcattttttgattaacggatcaagctctgatgcctcacttttgttcatattaaaaaacgcgggatcgaaagactcaatatcttgaagaaatccgccccacttactgatactttttcctttttcataggtgtcagagtagtatgaagaaatatcccatcgcgacgccgggacttcacggacactatgttgtcctttcttcaaatttctccagaatgtttctgtgtccggagcatccggaaactcacagcccattccgataatagcgatttgattcagactggttggttgcatttgagatccgctgtcccgtacttcggaagcattttgatttatatgttgctctttattccgaacctcaatattttctgaatcaatttgaggactgatcccctcacttgcaaataactcgttcaaatagacgcccagttgtgaaaaactcggatactccagaaaagccgaaggttcaatttttatttgaaatgcatcttccgcttttttgacaagctgaaccagtaagattgaatcaactccgtaatccgcaaaagacgtatcctgatctaaattcccgtaaggtattttcagctccgcggaaaaaatctccattaacttcctgatcatagcttcattgtcaccatgaccagagatcactttttcctcagcatccgggttatttttagccgcttgaattcttgtctgaagcagctgcttcagcttgaatttctccggatgtgtctttgccggtataaggcatggatatccgtttatcgtcatgatttcatccagcatggaaatacctgtttctgttgagtgtgaaagtaaaccgagtgcctgatatgatggacttgtcacctcgcccatcccaatgtccttccagctcggccagttaattgattgataatatgttttgccggctgcatgctgatacgccgcaaagtaatccataaaagcgttagccgcggcatagtcacttgttccggcgcctaataaaggaaaagcgctcgcaacagatgaaaacaaaatgaagaaatcaagttcgtcatcaataaaaacgtcatgaagtacttgcatcccctgcacctttggctcaaatacttctcttatttcttgatcagatttatgaataaaagccggattcgaatgattggctgcaccagcgcaatgaatcaccccgccgattttgccgaacttcattcgcacctctgaaaagaagcgatgtaatttttctttttccgtgagcggcccggaatacacttccacctgaactcccttttgatccaactcatgcagcagttgtaatttcgaataaagaggtgacttttcatcggtgtcttctaacatgccggctattttatcagattccggaaggtcggttactcccatcagcacaagttttttgactcccttgccggcataatgtctggcaagttctgctccgatccctcttgttccccctgtaataaccaaggtttgatccgtacggcataccggcagaccggataggttccggtttatttccgccgcatttaatttctcgacgtatggaatataacgatcaccgttccggtagcagatttcactatacagcccgtcagcgcaagcttcatctgtgattacctgtctcagttccgccgcagtcccgacatgcccgtctacatctattgtttttgattttatcttttgatactccgcgctcagcattttatatagtccggctgtttcggctccggctaacgacggcttgtcattcagaagtgtctgcagccctcttgtcacatgtaaaacgaaaagctttttacgtgtctttatgatttcctgcagcagtgtcagcttcccgattgtgccggtgcgtgccccgttttgattactccgcaaatctgacaggtcaatcatgccgatgatttccggattttcttctatgactgctagagccgtttttttggcttccccatccgaatgatcccagttatctgcgcaaatgacagcgggttcaatcagaggatctgaatcaaacaattcgaatgcaagccgctcactttcactattagccaggatcatcacctgtcctttcgtaaaagcggaaggcgcagccttttgttttttccacgatttttttaatacatcaaatgataagtcagtcggtgcatggggcagactctgcggtacacctgttttctgtttctgtgctgcttttgcggcaggcacccaatatctgttccgttcaaaagggtatgcaggaagagaaataagcttcggtaattccgcagtgtacatctcttcccattcaacgtctcctccgttcacccagtgaatggccatatctcttgcattttcaaagtgagcggctgacagggcattcttttgaccggcgcctcggcgggcgtttcccctatataaaccgtttaacttatgatctgaccgcaaatacatcgtcagcttatcgcgaagatcgtcaaggctgctaacctcaacagcgagccgctcttccatagcgtttctcccggtctgcgaagtgtacgcggcatcagctagtgacgtttttggctccagttcttttatatatgcatcaatcaagagtctgagccgttcttcatttttggcagaaagcagaataatttgcgtcttgttgctctgtaccgtttccatcttttcttcattcttgtactcttcgatgataatgtgggcattagatcctccagcgccgaaagaactgatacccgaccttctggcttgattttgcggcgtctcccaatcggtcaattcagactgcacgtaaaacggtgtttcctcaaaatcaatattaggatttaagttatcggaatgaagggaaggagcaagctgtttatacttcatttgcatcagcacttttgtgatagaagcaattcccgccgcggcctctaggtgtccgatatttgacttaaccgaaccaattgcacaacgataatcgcttttcgagctgtgcaaagctttggttaaacctgaaatttcaatcgggtctcccaaagatgtccctgtgccatgcgcttcaatataacttatgctgtctgcatcaatccccgccttatcaagagtttcactgatgacgtttgcctgctcgcccggatttggcacagtgtatccatttgtttttccgccgtgatttacagatgttcccttaatcacaccgtaaatcctgtccccgtcagcctttgcggcagaaagcgatttcaaaagaacggccccgactccttctcccggcacatatccgtctcctcccgctccaaagcttctgcagcgcccatcgcttgaaacaaaatgattttgtgaaagtaaagtatatttatccgggtgtaaggataaattcactcctccggctatggcgagggtggattctcccctttttaaactttcacatgcaaaatgaacagcagaaagtgaagaagaacacattgtatcaattgcaaggctgggtccgtgcaggtcaaagaaatatgacacccggtttgcgatagacgaataagaagacaagagcgcctgacgtccctcatcatctgaagcaccggctgcaaataactgatagtggctgtaggtgacgccgacaaatacccctgtcttatgccgtttcaactttttctttgtgtaacccgcatcttcaaacgtgtgccatgctgtctctaaaaataaccgttcctgaggatcaattaactcggcatcacgaggcgaaattgagaagaacagcggatcgaatttatcagcgtcttttataaaacctccccatttgctatcatgacgggcattgtcacctgtgtgataatatttccgaaaatcccagcgctctttcggtatttccgttatacaatcttttccggaagaaatattttcccaaaactgttccacatccttcgccatcgggtagcggccggctataccgataattgcaatatcttcctcggaaggtgcggatggtatgcgggaaacggaaagcttctcccgtttcgccggcgccgaatgatcaattcgctgttcggctgccggtaaaaacgccttcttcaactcatgttgatagtgttcaagaaaatactctgacagctcttcaacactgctgtattcaaagaaaagagtcttagacactcttccaaaatacttttcgagacgggagttaagacctaaaattgttagagaatcaattccgtaacggtcaaatgtatcctcgggtaaaatgctgtccgccggtcttcccgtttccgcaccgacgatctctgtcaatagacggatcgtttgctttttcagatctttttcatttaattgcggcagactgttgttttcaggcacagtctctatctttttatggtcagttgagagtaattcacttattctatctttgtctccgctgataacagccagctgagaagcagaacggctcatactgtcctgaaaagcggcaagccctgcttgggcagataaaagttccagccccgtgtgtcttaaagcctgcagctctgccggaccaactgtcatattccccgcatcccataaaggccaattaatagaaagtgttttcccgggacgtcccttaatgcttcgatactgggtgaatccgtccatacatccgttagcgaaggcgtagtcgctctgacccgcattaggcagaacggccgaaagggatgaaaacataacgaagaaatcaagaggctcttcttcagctgctttatccagccaaacggttccgaatactttaggcgctataacttcttctatgctttctttcgctttttttatgataaatgcatccttaacaagtccggcactgtgcaaaattccgtttaattctccgaatgtctgcttaatgtgcttaattaacgcgtccgcctctttttcctttgaaatatctgccgggacatataaggcttcagcaccgagattttcaagcgcgctcaatttttgcgccgtttcacgggatgccggagaacgcccggttaataccagcttgacttccgcctgtttcgccagatattccgcaaacagatacccgaggcctccggctcctcccgtaattaaatacacaccgttcttttttacactgaaactatgtttctccccatcttctttttttactcttttaagctgccttttataataatgcctcggctcataacaggtaaagtggtccgtcttgcattgattgttccattcaaaagagatgacatctgcaatatgctgctttgtaaacggctcgtcaaacattgatttcagctctgcagccttacatgtgaaattcggattttcggcctgtacggtcttaagaaaactttcaaccgcgttataaatgggctgaacctcgccctcggcattttcatacagaaacaaaacttctgctttcggacaaagtttgttcgccatgaaggcctgaaacatttgaaacaaggaaaacagacttttattgagctgctttcttattgcatcttctgtatttttgaagagcccggcagctaaaaaatgaataatatggcggggtcttatattttgagaacgcagaaccccgcatagcgcatcataatcctcatcatttgcaaagttcattttaaaacgaccgttccggcaatcttcgaaacgctcgccggaagtcacgtaaatgaaaggcgcctcatagccttcaagctgtctcttcattacggtatacatgctgtcgtctttgcaaaaaaataaaattggctctttcgtattcgggaatttttcactgcctttaaattcatgtctatcccataccatttcatatagatgggttttccccaaactcttaattaattccagcccttcttcacgcgtcaggctgccttctttcacctttttcacgatttgctcaatttgcatcgttttttcattcatggaaaagcaactcctctatcagctctgacgtctctttcgtattcatctcacctgtttgtgctttttcaagaagcgacatgatttctccatctgctgtatctttatttgaattgtgaagctcagtgttcgagaaagcctcaatcttctgcgcttcatctttatttaaatgaatccaatgtctgttcttactgaaaggataaagaggaagaggccgtttaaccggtttgagttcctcctcatacaagtcttcccagctgatttcacaaccgatcgtccacaactgagccagtttggccggcttgttttgctgaatcagtgattgaacatatgcatgaccttcggggccgccgaataaaggagcgtacagactatcaaaatccgttacatttccttcataaacaccttgcagtctgctcccctgaatgtaaccgtttaatttttcaagaagatctccggtattcgagcaagtgatcgcaaggcggcattcaaatggttcccttccggtttgcagcgtatatgctatttcttcaagaccgattccggacttttctctaaaattgccgttatacggtttatcagctgatcgattccagacgctgctgatatagcggcacagctcactcagggtcattaattcctgaaatatatctagtgatatttctgtgccgtacatttggtttatataagagattaattcggaataagccaacggatcaaatccgaattccgaaagaggtgtctttgcatctatatttgcggtatctaaacgcaggatacccgctgccgcttcccgaaccgcctcttgcacatcacgttcctgcacctcttgctgactgaattgaactgatagttcttcatgtaaaaacgctgttaactctttggctttaaccatcagcctttcctttgttttggccgatagaacaatgatttgatcccgctcggcagttactgctttatcttgtccgtattcaaattcttccacgatgacatgagcatttgccccgccgaatccaaaggaactgactccggcgcggcgcggaatttcatttccttttcgatcttttaatctggcccacttcatagttttattgacaatatgaaacggtgttccgcttaattgaatgtaagggttcagctccttaacatgaagtgtggcaggcaatgttttatacttcatggatagtaatactttaatcagccccggcattccagaggcgggctctaaatgaccgatattcgtttttactgaaccgatgccgcaatattggtcatgattctttcctggatgcggctcaaaagatccaaacgcttttttcaagccttcaatctcaatcggatctcccagttctgttccggttccgtgtgcttcaatataagatatcgtatcaacaggaatatcggcatttttgtaaacagacgttattagttctgcctgagcttccgggttcggagcggtcaatgaagcagatcttcctccgtgattttctccggttcctctcaggactccgtaaatattgtctctgtcattcattgccgcttgcaatggtttcaataacagaacagctgcaccttcaccgcggacataaccgtcggcaagtttatcaaacgtcttacaccggccgtccctagacaaaataccgagtttatcggtatacatatgcgtgactggatctaagagcagcgaaaccccgcctgctaccgccagctcactttcgccattttgaatcgagcgcacagctctgtggattgctacaagactgcttgagcaggctgtatcaatggactcactcggacctctgaaattaaaatagtgggatacacgattgctgatgagcgcctggctgtttccggttcccgcaaacgcatgcgccccgtccgaatgcctcatcagcagctggcggtaatcattaaattgaatgcccgtaaacaccccgatatgtttgccggacagctttgaagctttgtaacccgcatcttctatcgctttccaggtttcctgcaaataaattctgtgctgaggatccatgagttctgcttcccgcggattaatattgaaaaacgcctcatcaaatttatcggcatctgtgataaatccgccccatttcgaatgtacttcgctgcttcctttgccttcggcgtattttttccaatcccatcgatccgggggaatttcctgaatcgaatctttttcattgattaaattgatccaaaactcatctgcattttttgctcccggaaaaacacaactcatcccgataatggcaaccggctgcttctccggatgatggtcagcctgtcttgctgtctttttttcaaacggaaaacttcgcggcggcttcacggttttccctgcggttttcccggcgtgcactttccttttttcagaaatatttttttctgcacctgtattcccttttgcaacagtacgcagttcactgtttaggaattctgaaagagactttatatggctgtaagtaaagaaaacggcaggtgtcagcttaagcttgtattttttattcagtctgacagctaatgttttcaaactgatagaatcaaagccgagattgccgaaattctctgccgtatccagctgttcaatgttaattttcaataattccgacaccatttgtttcagttcttcaaggacattgtctgcagaacccggtcctctataagaactttcctcttgacgaaccggaagcgtatttactttttgatgcggcagatctttttttgctggtgttgttccggcatccccggtaacaaccgaaatttgcggacagtcacttgccaaaattgtctcaaaagccgctatcccttcttccgtttccaaataatcaaacccggatgcggaaagatatgcgtcttcagcttctttgtttaaatgcattccgcctttacgccacaacggccagttaatcgaaatgctcttgccttgtctctcttgcctgcggctctgttcggatctccaatttatatattgatcttgaaaataattgcccaacgcatagttaacctgtccaaaatctccgaagaccgaagaaatagaagaaaatacgataaagaaatcaagcggctcatctttcgttaattcatctaagcataccgttccttcaattttagcagtcatgccttccgtaaaatcagtcagattcatctctgtaaataaccgatcatcggcatgaccagctgaatgaataacgccttgaatggatccccaagtccgtttcgtttcttctatgacccatcccatcgtcttttgatctgcggcatcagcttgataatataccgcgtctcctccaagcgcctgcagccggtcaatgttatgtcgtttatcagctgttaacggtgatcttcccgtcaatactaattttgcttgatactgagaggctaaatattttgcaaaaatcaggcccagaccgcccaaaccgcccgttatgaggtaaatccctttctgtttcagctgatgagagtgctctgtatgattgaatacatactcctttaatgtcttaacatacctcttgtcatttatatatttaacttcttccgcctgccgttccacgcctgaaaccatttcgttaagacaaaattcagccattttttcaattgatatacgttctgaaaaaccgattgacttcacattctctgcggatggcaccaacatatttgccgtttttaaacagcctgcaagagcgcccgtatacggatcattcatgccttttttaaaagagtgaacaagaagcagagaatgaagataaagagaggcgtcactgcgggcgctcagggcttttaataaataaaaaattgattccaggccgctgagaaggcggtcacccgcgtaaaatgtttctcccgtgtgcaagatgacatcaggagaaaacccttttttctccaattcttcgaataaacgaatataatctgacgtcacttccgggtttatacagaatgtcagcagattttgatcggtctgccgctgatccggcgtgacgagaatgacacggctgtctgattgatttttcagagcttcagccaacgcttcatcttttgcaaagaccagaattgtttttggctccctatctttcatttcaatcagagggtttttttgatcccactcatgctcataaaaacgtacatttttattaggcttttcgccaaaaaccagcccgctcagttccatcaaaatcccgccggcattgtctaatacatacacatcataagccgaatcgctttcttcagtttgttctgcatatacataaacgggttcagtctcatgatcaaaaatcgtacattctttaatattttccggggtctctccggcattttcccccgcaaggtatacgacggcttgatatgcgctctcaatcacttccggtttgattatgcaccctttcggcccggcctttgcttttatctttaaaagcacctgtccgttcctgctgacgcagtgctctgcggctttcagactgtcactgcagctgtatccgaattcggcaagccgctgataaaacgcttcgtacggtatacggtctgcgccctgagacaggaacggctcaagatgaatatttccgttctcgtacgccccgccttctaattcgagccgccctgaggaataaatggataagtcgctctgtttttctatagaatacgatgcaccctgattatccggggttaatacaatccggatctgctcattgcttccgctttgtaacatcggttctctaaaggagagctcagttaatttaataatcggattccctgaagccatcgctccggcagctctcgccatttcaatctggctgagaaacggaaacatttccttgtcttgatactttgtttttatatacaaaccggtatcgcttacattgataagaaacttctgggctttaaaatcagatatattgcatgaaatgtaaggatgcagatcgttatttacgttcatccggcggcttcccgtattttgcgcatctattctgcatagctctttggcaaatggatatcccggtgctgatacccgtctcaaagtgacatctttataaagtgacagccaatctactccattaccgccaacccagtattcagcaatcttcacaagatccctgtttgcggctgattcttcaatttcagctttgttcgtcctttgagcttctgttgtgtctttgccgcttgtaaaaatatgatccctcgcatttccgagagtatagtctgtcagccctttaagcaattcatctcttgtggaggcgataacagccaatctgtgcggcatttcttctctcccggtttgtaaagtaaatgctgtatttctaagtgtttctaatgaataatctctggctgctatttgttcttttgcgcgttttgcatattctgccagcctgtcggcattttttgcagaaaaaacaaataaaagctgttcaggttcttcagccgcgagaggagagatagcttcatccgcaaattcttctaaaataacatgggcattagctcctcctgccccgaaagaactgattccggcacgcctgggaacggatgactcccatttttcggctctgtccggtacataaaaaggtgttttttgaaacggtatattctcattcaattcagcagaatgagtcagtgacggaacaatcgttttatgtttcatttgaagaataactttcgtaatgcccgctatgcctgcagcagcctcaagatgtccgatatttgatttaaccgacccgatcgcgcatgtcttcttatcgcgttcggcacctgaaaatgctttggtcaggccggtgatttcaatcggatctcctaacgcggtgcctgttccgtgagcttctatatagctgatgcttttgggatcaatacatcctttttttaaggctctcgtaatgacctcactttgagcttttggattcggcacggtatatccattcgtcttagcaccgtggttgatcgctgttgccttaataactgaataaatctgatcaccgtcggcaatagccttttttacgggtttcagcagcacggcacctgtcccttctcccggcacatagccgtctcctcctgaaccgaagcttctgcaccggccatcactggataaaaatcctccttgagtcaggagttcatatttatgaggatgaatggataaattgacgcctcctgcaattgcaatttcacattcattcctgattaaactttcacaggcaaaatgaacagccgttaatgatgaggaacacatcgtgtccaaagcaatacttggcccgctgaaattaaagaagtaggatacccggtttgcgattgatgcaaatgaggaagaaacggccgcttcgtgaccaacgctgtacagctgatattggccgtacataacccctgcaaaaacaccgacgttttttctttcaagcgttttctttgcgtacccggcatcttctatggtgtgccaaaccgtctctaaaaacagtctctcctgcggatcaattaattcagcttcggcaggagaaatattaaagaacaacggatcaaaatgatacacatcgtcaataaatcccccccatttgctttggttttttacttcgtcgcccgccgcaggctgatagtgcagcctcgaatcccaccgatcctcaggtatctcagttatacagtctttaccgttcaataagttttcccacagagtatcaagatcatttgccatcgggtaacgtccgctgataccgataatagcgatatcattgtcatgatacttctcctgctgcacctgatttttcatctggattttctgtttcccgttaacatcggctgtctgtttattatcttttttcttctgagatggagtgccgctcccgttttctcctaaccggagtttatgaagaagagtatccctgtgctcctcaacgaaatactgtgacaattctgccgcagtctgatattcgaataacagcgtttttgagagcgcgccgaaatgtttttcaagctcattcgtcatattgataatcataacggaatcaagtccgtatttttccaatgcctcttctgcatctattttgtccgcaggcatcctgaattctgcagcaattatttttatgataaaatcagatgtttcagctgtcagtttctctgaatcaaatgattcgatatttctccctgttccttcatctgcctgaatattgtcttttcgttcatataattgatgaacatgattgtcaatttgctcatctccgtaaaatacagtgaattgcgaaaaaccggaggacaatgcgacggcaaacgcttttttaccttcttctttttctaaaggataaaaacccgcctttttcattgtctctaccgttcgctcatccacttgcatgccgacttctttccacagcggccagttcagagagagagaaatcgtatcagaatgctgggcagaacgcatattcataaaatgatccatataactgtttccgaacgcgtaatcagattgcccgacatttcccaacactgcggaagtagaggagaagcaaatgaaaaagtcaggattttctttctcaacagcatcattcagccacatcgtacccaatactttcggtctgattacctgatcgaattcctctcgtgacttgttaagaaggaaagaatcccggatgattcccgcgccctgaatgaccccgtttacttttccataagaagttttggcttttttgactacatattcggcttcttccttattggtaatatcagcctgaacataaacagctgaagaaccggcatcctccaatcgcctcagctgttttcttatatgatctgaaagcggagatctacctgttaaaacaaggcagcattttgtttgaaaagccaaatattctgcaaaggtaaatcctaatccgcccgcgccgcccgcgataatatatactccattttctctcagcggcacagctccgcttccggaatttttttcgggttcatacgttttgagctgtttgacataacgctgcatgtctttataacggatctctacatctgaaggctggaaatcactcagctcattgcgtatgatatcagctgcgtgaacggctgctattgactgctccatttcaatgctttttgctgagattaacggattttccagctgtaatgtccgcaaaaatccgcttgccgccgcgtaaagaggctgttctccggaaagatgcgaaaaatatccatataacagcttgatcggtttgcggcagttatttttgaagagcgcctgttgtaataaaaacaaagaatagactccgctgtcgcattgttcacgaattgctctctctgttttttcaaacggcatgtctgaccataaatgcaccgcttcccgtatatctgacttctcttcttctataagccatcctaacaggtttatgtaatctttttcagagcgggggtcgatttcaaatacaccgtccccggtttttcgaaactctttccccggcttaaccaaaataacccttgtatcatgcaatgcagcaagttctttactcacatcttcatttttatcaaataataaaaggctgccctcacgccggccgccttttacatgtatgctgagatctgtccgctgccagaccgtctgataatatatcgcctgtccgttaccccctgcggaatgagaaccaagctgctgtatccgctttactccttcttccaaagaaatgatgccgctttctatgtcagaaagtactttttttctaatatgacgggcttctttcataaaaatcttcatcccctttacaaatggcactgccgcaaaatgataaactaatcctgcatatgctccagcgcataatctgcttcttcggcagtcagttcgcccgcttttaattgtctgagaagctcttttactctctcgttctttccattggaatccgctgttgcacgagtctgtgcctccgcggaaaacgtttcttttttacgaatggttacatccttcaaacctgcaagtctttctccttgttcattaagcagctgaatatcgtaaataagctcggattgacctttttggcctgttttacgcgcatatgcccagcattctgctgaaacttttttccgaatcgtaatctctcctattgaaaaaggaacataaacagatgcctcttctcttccgtccgtaatcccgaacaaagattgcagagccccatcaattaaagacggatgcaatgtataattttcaagagcatatgcggcttcttttggcagcaataagtgtgcaaccgcttctgtttttccgccccataaacgttgaatcggctgaaaagcgcgcccatacaggaacccgttttcccgaaaatacttgtaacattcatcttgttcacggacaaaagcacttctgtttatcatctcttgtctgtcgatattctctatatcatcatcaccgtaatgatgatcataatctaattcccccgtcacaaatccagtccttacagcagcatcctcgtcagatgacatattaaataatattttgccgtcttttacggaaatgtgagtgtaaatggtcagactctcttgcaaaagcatggccggtcttgcaaagatcacgttttttaaacgagtgacctctttctttcgatatgaccgcgttcccgctgcgcatgccatttcaagaaaagcagctgccgggagaatgctcttgttttttacgatgtggtcttttaaccaaatctctttttctcttaatgtcgttttaaaaaactgctgttccagagtagattcattcgaatccagaagcgggtgcagtgaagactgctgcggcaatatttccggaaatattgcgctttgatttcgaggcacccagtaagactcctcagcaaatggatataaaggaagcttgaccttttgcggggtatactcttcatataactctctccattgaatatcagccccgaaagaccataattttgctagaagattcaagtcctttgtctccatcatcacttcgaggaatttatctttcatcttttgatcatgaaagataaagactttatcaaaatcttttgtaacattgcctttgtatacgccctctccaattgttccttcagtacagaaagttctcagcttctccttaagttccggcaaatcggaagctacaacagcaagtctgtcttccataggctccctgcatgtctgcaatgtaaaagcgatatcagctgccgaggctgttgtctcccgctctgtgaattgcagaaggcgccgggcgtattctttcagtctgtcttcatttttggcagaaagaactgcggcaaacggaccgcttattgtttgtgtgtccgcatggttttgatattcctccacaatgacatgggcatttgctcctcccgctccgaacgaactgattgctgctctcctgttagaggcgcctgattctttccgccactcttcttctttctgctgaacgtaaaaaggcgtcttttcaaatcggatattttggttcagctgttccgagtgaatggatggcgccaacttctgatgcttaaattgtaaaagaacttttgtaagggctgctatacctgcggcagactccaaatgtccgatattagacttcactgaacctatggcacaaaattgtttatcatccgtaaatttctcaaaagcttttgtcaatcctgcgatctcaatcggatctccgagcgaggtacccgttccgtgtgcttccaagtagctgacggatcgcggactgatgcccgatttcttgaaattttcagcaatcagctcagcttgtgcattcggattcggaaccgtaaatccattggtttttccgccatgatttacagatgttcctttaatcactccgtatatatgatcctgatcagcaattgctttttccagaggtttcaacagaacggctcccgaaccttctcccgggacatagccgtctccgccctctccgaaacttctgcacaatccttcggtggaaacaaaattaccttgactcagccaaaggtatttgctggggtgtatggatacattaacgccgcctgcaagcgcaatttcactttcccctcttttaatgctctcacatgccaagtgaatggccgtcagcgatgatgaacacatcgtatccagtgcaatgctcgggccggagagattaaaaaagtacgaaaccctgttggcaatagatgaaaagaaggaactgagcgcaatcggattgccccgcgcagtttcttctgcgccgaataattgatattgtccgtacatggctccgacaaatacaccggctttcataccgttaagcttctcttttgtatatcctgaatcttcaaacgtatgccaggaggtttcgagaaaaattcgctcctgagggtccatcagctcagcttctttatgagaaatgtggaaaaacagcggatcgaattgatcaacaccgctgataaaaccgccccacttactgttgattttccccttctccattctgtcgggactgtaattcgatctgaaatcccaacgttcctcggggatttcaataatacagtttttccctccggcaatgttttcccagaactcctcaagagtatcggaattcggatatcttccgctcacaccgataatggcaatatcctcccccggctgatccatgctcggtgcaggtgtatccttctgctgccggtgctgttttttactcggattttctcttttcttctgtactcttgttaccggagctgcccctgcggccttaagcactttttctttaaaagatgttaggaagaagtttgaaagctcttcaatgttctgatattcaaaaaagattgttttcggaagatccccgaaagtatcttcaagctttgcaataagtgacatgatcataagtgagttgattccgaacttctcaaaagagtctttcgcatttattttatgagcttggattttcaagacaccgctgatgatcttgattaaatagtcattgactttttctttcgcagcatattccgcttcttcatcgtgttccgccgtgagtgtatcttgatctgctgcagctgtatttctttgaatcgaaagcgcctttatcattttatcccgctcaccttctgcaggcattaagctggtaaatgaagaccgcagcattttcagaaacgcttccagaacagaggaagttcgcatcggagtcattccgtatttttcttttatttgaacgattccactgctgtcgagactcattccgccatctttcaataacggccaattgattgatagtgtttttccgtttcgagagagctgggatcgaagcattgcaaaactgtccataaaatgatttgcgtacgcatagtcactttggccggcatttccgtaagcggaaaaagaagaaaagagaacaaaaaaatcaagatcttcgtcttttgtcagctcatccagccagattgtcccgtaaactttcggtttcagtacgtccgtaaaatcaccgggacttttatttacaagaaatgaatcacgaaggatgccggcagcatggatgatcccgtttatgctgccgtaccgctgtttaatgccgaaaatgaatcgctctgcctctgttcgatctgttatgtccgtccgctgatattcaacaatagagccgctctcattaagcatactgatccgttctttttgatcagctgttaaaaaagaacggcctgtaagtataatcacggcttgattttcattagcgatgtgttccgcaaacagcagcccgagttttccggctcctccggtaatgatatatatgccgcctttttgatacgttacagatccgttatcgtgttccggaatatcaataggctgcagccctttcacataacgggtatatgagtctattaaaatctcacattcatccgtttgaatgcgctgcatttcactgattgcagcatcccacatctcggaaaccggaggatttatgtcagaatcctcgtggcgtatctgtatggttttcgctttaagcttggagctttccatgtttaccgttttcacgaaccctccgacagcttcatgaaacggctgattcagaccgcttgtccaataaatatgcaataacgtaacaggttcgtttcttcgcattaaagcttttgataataaaaagagcgagtttatccctctgcgaagagattcattaacagattcttcagtgaattctctgatttctctattccataaataaagcacgacatcaggtgtaaatccgttttcagccaaatcagacagcagcatttcgacatgatgttcatcagaaggattgattgtgcatctattccgttcaattctgtaatcagaatcgggcgttacaagaatgacacggttatgttctccattcatcatctcggcatgctgaaaaagacggttatcctgatcaaaaatcagcatattccccggtgcctgctgattcggcatatcaatgtgatttgtcctgacccaatcggtcttaaaaaaaatggttggggacggagcttgtgattccggctccgcctttttttccatttgttgttttctgtaagtacgaattagctccagtcctgcatcaggagacatttgctgttcttcaattaaggaaagtatttgtttgatctgcactattttccctccagcagctgataaacttggtcagcagaaagttcaccgtttttcaattgttccaataagaagagaatttcctgatcttcatttttatgacctgcggttaattctcccccggtcacttttctgacagagaagtctttcatgctcacggctacttcgccgctctcgttaataaaatcaatgttatacgtataaaaaccggtttctctcaccgaaacatggcatcgggcagtaagcgccctcttaatgtgaagctctctaagtgaataaggaacaaataagccgtctttctcattttctcttaacaaaaatgcagccgcttgaaaaccgccgtcaattaatgaaggatggagtgtaaaatgtgaaaacccgttcgctaaatgatccggaagctccaattctgccattaactccacatcaccgcgatatacggctttcaacgtttgaaaaccgctctgatatgtcaggcccatacgactgaagcggtgataacactctttccggcttatgaccgttttactgctgcgtatgaactgatcaatatcgacatactcaggattgctgtttatgtctccgaatactgtttcacattgtgtgcagatttgctgcacgccatccgggccctctttacatatcgttgcgttcaacttatcttgtttcatttccaagccggtataaatgtgcagcgtttttcctttatataatataggtctgttccacatcacgtcttttattttatatactttactttctccgcttatttccgcacaaactagagccatttcaagcgaagcggctcccggcaacacacagtctcctgaaacaaggtgatcagtgacgaaaaattcagttccggaaataacagttttaaatgcttgtttctttaatgttgagacattctcgctgattaatgggtgaagacttttgctattaacctcgcctttgttctttttcggagtaaaccaataactctcttttgcaaacggataagacggcagcggcactctattcaatttctcattgccgatggtcttccattcaaactcggctccattggcccaccattgtgcgagcagctcctcctttccgctttgaagagcctcctgaatcatatattcagaaacagctgcacgctcttcagtgttttcgcttataaatacgccattttgcaccttgcttttatcaagaaagctgacgtatttatctctcagctcagtcagactcactgcacatacggcaattctctcgttcattgcttcccggccgttttgcaatgtaaattccatgtcactggcattaacggtcatgtcaccggcaatcacgcgatccaagtactgaaccataagccggatatactcaagtaattgatctttggttttcgcagataaaacaaaaatgtgtgttttaccgttgttttccggtacttctttttgaggttccctatattcctctaaaacaatatgtgcgttcacaccgccgaatccgaatgagctgacacctgctctcctcggcagatcgttgttctcttcatcttttatcggattccacttttgagcggtttctgtgatataaaatggcgtattttccattttgatgtatggattgagttctgaaaaatgggcgagtcccggaagtttgcgatatttaaaagccagtaacactttcagcactccggctattccggcagcggtttcgagatggccgatgtttgttttcacagacccgattccgcagcttttctgtttctcaaaaggaatgtcccattcttgatataacgttttaaatgcctttatgatgctgtttacttcaatcggatcgccaagacttgtccctgtgccatgcgcttctatatatcccgcagtggcgggactgacccccgccttccgccaagcttcggttaataagtccgcctgtgcgttcggattcggagctgtcaaagaattggcgcggccgccgtgatttacagctgaccctttaatcaaaccataaatatgatcaccgtctgcctgtgctttgctgagcggcttaagcagtactgcagccgccccttcactccttacatagccgtcagcgcttttatcaaacgttttgcactttccgtctttggaaagcatacctgctttatcaaaagctataaacagagtagggcttgtcataatatgcactccgcctgcaatcgccatttcaaaatcgcctctttgaatcccctcagccgcacgatggagtgcaactaatgaacttgaacaggcagtgtcaatcggttcgctcggacccgtcaggttcagctggtaagaaatacgattagccaatatacaatgatttaaaccggttgcggtctgcgcctgaacagagacgccattttcattgagacgttccgcatagtccgttgtggcgacccctgcaaacaccgcggttttcgtccctgccagatctgacggcttatagcccgcatcttctattgttttccatacagtctccataaaaattctttgctggggatccattaattctgcttcggcgggagaaatcccgaaaaacaacggatcaaaactgtccgcgcctttgataaatccgcctttttttatttttgttctattgacgtccctgatcggatcgccgtcaaactctttccagtcccaacggtcttcaggaatgtctgtaatcatatcccgccctttttcaattccttcccaaaagtcttccagcgtatctgtttgggggaaacggccgcttattcccactattgcaaccggctcattcatatgtctttcctcttgcctggttttgttttcaggctcaggggaatgttcataggattccggcggaggcgtgctgtacaatgttttttcgtctgctgcagaaaaaggttctgtctcagcaaaaaggatttctccgtattgctcgattacataatcagtcagttcagccagtgaattgcattcaaagaaaatggacggcaataattccgtaccatattgttgattgatttcatttccgagtctggtaaacgtaatagaatcaaatccgtactcgccgaatgaagtctcttcttccatttcctttctgtcaatctttaaaatactggacatcatctttgcgatgccctcaatcagattttctctcctgtctttcgccgcagattcatctgaagaaaaagatccgcagagatgaagctcttcggaatactcactctttaaaaactcaagaagttcattaaaatcagtaagaccgaaaaaatctgacggcatcattgatattcctaatgtttcgtttaattcgttgcccagcattgtaaacataattgaatcaaatccgtattcacttatcggcagttcaaaatcaaattcccgttcttcaatttttaatacgccggtgatgatgcgcgtcaaagtgctttttaaagattcagttattgacagctctttcggttcgtgattttcgtcggcgattgccgggtcactttttccgctgtcaatcgttatcattcgttccagctttaattcattaccgctaaataccattatttgatgttcacaccctgtcattgcttgatcaaatgctgcaaggccttcccgttttcccagaggcagcattccgaaacggtcataaaggaacttctctgaatgaatgtcaatttgcataccgccttctttccataaaggccaattaatcgagactgtttttccaggtttattttccgccgctctcatttccgcaaagtaatccataaaccggtttgcataagcataatcagtttgtccggcattcccgattattgcgctgatagatgaaaacataacaaaaaagtccagaggttctctgtctgtataccggtcaagccatatcgttccgtaaaccttgctggccaggactgaatcgagatcctcttcacgcttattgatgagtaatgaatcttttatcacaccggcgctgtgaataactcctttaacaggacctaatttgtttttgacgagttttatcaggttgttgacattttccttatcagaaatatcggtttttacataaaaaacttctgatccgtttttttcgagctcttttacattgcttacggcttcctcagaaagctctgacctgccgataagcacaagctttattctcccttttcgcacaagatgtctggcaaaaatcaggcccaggccgcctgttcctcctgtaataaggtaaactcccccttcttttacttccatctttttggggggctctgccctttcaatttctgcagagtgtttcacctgcctgattccatctctgtatctgatctctgaagcatcatcgctgatgactgtttctttcacaaggttttttaattcaggcagaccggtgttcagctgtaactgaatttcatcgctgtgtatttcaatatttttaccggacaacattggatgttctaaatgaagcgacctaaaaaagccgctgattgccatttgataaggtaagatttgattgttccttgtgaaaaatacatgtgatatcagaattttatgtcttgggattgttgctaacagagctttcgttacattgaaaaccggcaaaacagcctcttccagcttttcatgaatgttatgctcaattcccgtttcagggctcatcccgattaaaatgacgcggtcaattgtcacttgtctttctttaagaatcgccagcaatttcttatagccttcaagtttgacgctgttcaattcaaaggaatcagcttctttttcttgaaaacttccgccatggcggacaaagatcatgttcaggccgatatctttatatgcctggcggatcagcggttctgatatatcctgacggagtgaaattacaaggcagctgtttaaaccgctgccttcaggctgatgaagcataggggcccgcttccacatatcagagtaatacttagctgaatgccgctcattttgagtctgcggtgcagcccttaatgccttcaacgctaagttttttattttaagacttacagatccgtgttcatccataaatagtatatgaaaccttttgacatcatcatgttgtctttcatcggcagctgtaatgtaagcatagccgcttgccgaaggtggttgaagaatttccagctcacctaattcaaaaggcaaatatgcggtatgatcgtcttcctgaccggacgtaaacccgattgtggattgaaaaatgccatccaataaacacggttccagcagcccgccggattttttatcaatgctctcaggaagtgatattcgtgcaagaacagcattttcatggataagcagctgttttattacctgaaagccggctccatagtccaaaccgctctgccggaagtttctataacactcagcgccgctgattaatcttttctgtccggttaaccagctgtccaatttaaaatgctctgtatgagaggcgtctttatctccgcatgtcataatgtttccttggcaatgaactgccgcttcagattgcatatcggttttcaccacaaatctgccgtctttttgattcggcagcagatctatcattatcgtcttttctttttcaacggttatcggaaccgcccatacaacctgactcagttttatgactgattttccgtacagcctctctcccgcttctctggccgcttcgatgattgccgctccgggcagaaccatattcccatgcacaacatggtcttttaaataatattcagaatctgaaagcgttttataaaatcggcactcaccggcagaaaaatcaaataaaggagctgtaccggctgctgatgttgtttgcgccttatttgacacccacagtctgttttttaagaaagggtaagtcggcagcgcaatttttgccggttttctgccggtgcggaaatcttcccagcttaaactccctcccgatacccagaattcagccatgtcggctaatgtggttctgccggaattgagcggaagatccgattgccgctgtccgcgtttatgattcggttttttccctctgaatatttcgtgatcgtcaattccattataaaagtgatttaatttcaacatcaggtcatcgatatttttcgaaatgacagcaagcctttccggcatggcttcccgcccttcaagaagggtatatgcaatatcagaaaggtgaagcggcttatttgttcccgccggctgtaaacactcgccctgcttatgacgagccttttgaagatattcctccagcttttttgctgattcccgtaaactcagtgaatgcttggctgagagtacgataagttcttcactttcctcacgccccgtttgacagtcagcagcagactcatactcttccacaagaatatgagcatttgccccgcccgctccgaaagaacttaatcccgcacgccgcggatatttgctgtcagaatgtttttcattcgcgggttttatccagtcggcagtttcctgctggagacaaaaaggtgtctcttccagataaagatccggatgcacccgttcagcatgcagtgttgcggctatttttttatacttcatttgtaaaataatctttgtcaggccggcaatacccgcggccgcttcgagatgaccgatgttagatttaatcgatccgagagagcaatatgaaacatcttcggtataagctctgaacgccttggtcagacctcggacttcaatcgggtcacccagcggcgttcccgtgccgtgtgcttcaataaagctgacacttctggcgctccaaccggccgctttaagagctccttgaattaaatccgcctgtgcggcaggattaggcaccgtatagccattcgtctttccgccatggttaattgccgttccttttatgacggcgtacacagtatcattatcacgtatggcatctttaagcggtttaagaataacggccccgacaccttctccgggcacgaaaccgtcgccgccttctccaaaacttctgcattttcccgattttgaaagcattcccatctgacaccggtataaatagtcagaaggatgaagatacaaatttactcctcccgcaaccgcaaccgagcactcacctttttttaaactttggcaagccatgtgaattgccgttaaggatgaagagcaagccgtatctacagggatactgggacccgtaaaatcaaatgtgtaagacactctgttcgcgagagaccacgggaacgaatttggaagtacatcgtttttgtccgtcggtattctttcgccgagcagcttgtaagaattggttgtaactcccgcaaatacaccgacatgtttttcggtctgctttctcaacccttcaatggtatatcccgaatcttcaaatgctttccatacggtttcgagaaatattcgttcctgaggatccatcgcttctgcttctctcggcgatatttggaaaaacaaagaatcaaatgattcagcattctttaaaaatccgccccatttgcaataaattttcccctcatgcgctttagcgggatctggatcatagtaggtctcataattccatcgttctttcggaatttctgtgattgaggttctctcttttgatagaagatcccacaattcttcgatattttcagccccgggataacggccgctgataccgattaccgctatcccgtcaagatgttctttttcctccgccgcagatgcagtggtgttttgttccggcctggcgggggtaatgctctgaatctgttttcctttttcctcccgtgaaaataaacgtcccagccgatccgggtattcttttacaagatgatctgctaaatctctgattgtatgaaattcaaataaaagcgttttcgaaattgctcccagtgactgctccagctttgtgttgcattgatgaatcataacggaatccattccatattcagccagatgcacatcttgatcgatctcttcccgttctgcaccgacctcacaggagatgatattggttaaaaacaaaactgtctgatccaaaatatcgccttgagccaaaggaacggcactgcctgtctctgtttcgtccgtcaaaaatctctgctgcataaattgttcaaagcgttcatgatcaccgcagactgcaatattatgcagctgacccgaagttacaatccgcgaaaaccattgcgttccgtcttcagcaggaagttcttcgagccctgaaccatgaaaaagagacgtccgcccttgacctgacaggttcgcccccattccgatgtcttgccataaaggccaattgattgtcagggtgcggccgctgcgcagagaattttgccgtttctgttcccgatattcggcaaaatgatctaaaaagccgtttgcatatgcataatcacactgaccttcgttgcctgcaatagagacgactgaagaaaaaacggcgaaaaaatctaattcgagcgacttcgttgcatgatcaagattcaatgcgccatgaactttcggagcaatcacctctgaaagttcatgctttgtttttcgaaaaagcagcgagtctctgataactcctgcacaatgaatgacgccatgaagacctgcatgctgatcggtaataccgtcaatcattttttttaccgcttctttatcggatatattcgcctgtatataataaaccttggctttaaagctgttcaggtattctaaatgtttctgcttatctccgtttaaaacagatcgccccgataggataatggtggatctttcagttttcgcgcaatattcagcgattttactgccaatccccccaaatccccctgtaattaaatatactttatctttttcagggtattgaatggtctttctgtttgtttctctctgcttctctaacatccgtgcatatcttacgcagcctctgtaagtgatatgaatatgccgatcaggcgctgtgtttatttctttataaagaatgtcagccttctctgaacatgaaacggatgcagaatcatgttcaaagcaaaccgtcttacaatgcagctgcgggtactcttgttttaccgattttaaaaaaccgttcacaccttcaaaatacggcaatttttctttttgatctgcgctgaatgtataaatgaacgttactttgtttataaggttctcgctgattaaagccttagtcagataaaacacagaataaattcctgatgcgagtgtttcttccagttcaggctgtttttcagaccaagtatgcaaaattgcatcgggcgctgcgcctttttcctttaacagacgaatgacaccttgataatcttcgggacactgcctgttgatggtgaaaacactgtcgcttatctgctctaaacggtcaccgggcataataagatatgcggacgtattctctctttttttcagctcttcaaaatagtctttattcccggagaacaacaaaatagtacaggcttgtccgctgcccgcttcattctcaagtgcggtttctttccataccggcgtataaagtgcctgattcttcttttctgaaaaagccgcgtctgattttaccggctgagggtttaaagaaaattgagagcgctcaaacggataaggcggaagcggggcttttcttttatgataatcacctagtttcgcccattcaatctcttctcctgaaagccacatttgcataaatgaatgataaagagcctcatcagctggtttgtccgcttcaaaagcagccgctttgtttagttttgctgatggagggagcgatccgaattgaaaaactgaaaaatcagagatattcacatccggctccgttcccttttcttccgtgtgaagcggcatatggtcagctatctcctgaaacacggcatccatctgattgtattctgtcatcagcggaaaacgggccttatcataaaaacctgccggctgctcattcatacaagcaacagcctgtttaattccgtcttgctttttcaataacatgctcagaaaaagttctttagacaagattccttcatccagtaaatttaatatttccagaacataatcattatcaaagaatccatcataatctgttaaatcccatctcttatacagtcttctcatagaggcaaggatagccatgatcgccgcttcctcttcagccggcaatgcgtttcttttatccgccgtgcgattcacaatataagataaaatctcgatttcctgagtctttcccgctttatcccactcttctaaaaaccctttaaacgtatattggtgctcaagaagcagccgtgttttcccgtacaggcggtctgtaaaatcagccgggaagctcagaccgttcagcagcatccttacatattcttcatttaatcgaaccggcgggtacgtttttgaagtgtacggattgacaaatggaatggacggcggctcgcaggataagtgcgaaggtttttcagcgcctgtgatgacagaaatggccttttcaattttgatgatatccgctgctgcaagagcgacgtaatatccgtctccggcgcctgtaatgagacttggcttaaaaccggatgccaggatactttttatgatttccgtattgataactaaagaatacaagcggattttctcaggcgtccattttcttttaaatgaactgtgcaatgctggtatacccttcagcaccgaccttacgttcttttctagatcagggaacacgcgtttcaaaacggcaaattgtttataactttcccatttgaagtcaccgatggcaagcgcccattcagaatcatgtttcctccgaaaacttaatccctctttaagctgatttttaaattcctccttgctgcctgccaataaacccgccctgtaatcaaacgatgtccttgttaaaagggtgctgctgatcgcttcatttgatattttgcaaaattcctcagaatcgtcagaaaaggttctccaattatgtatcatttgtttcatgctttcttcacttttagcggaaaaaaggaagggagcccttacctttctgtcagtttcgtcatttgtatgtataaattcttcgatgatgacgtgagagttaacacccccaaaaccgaaggagctgattcccgccctgagcggagccccgtctgccgccttccaatcacttgaatcaagcgccggcctaaacggtgttttttcaaactgtataattggatttaccgtatgtacattcaggcttttcggcaccctccgatgtttcatcatcattagaacttttatcaatccggccattcccgccgctgcttctgtatgaccgatatttgttttcacacttccgattctgcaatattgagtatcctcagtatattgccgatatgcttttgtcaatgcttctatttctatcggatcgcccagagatgtacctgtaccatgtgcttctacataagaaaccgtcgcagcatcaacagcagcgttgtgtaaagcttctgagatgacccggcactgcgcttctgctctgggagcggttatggaacgggatttaccgccatgattaacagccgtcccttttatgatcccgtatatatggtgaccggcttttactgcatcaccaaggcgctgcagcaatacaacgcctgccccttctccgggaacgtacccgttcgccgctgcgtcaaaggttttacatttgccgtcaggactcagcattctggctttagaaaaagaaatatattttccgggttggaaattcaagtttactcccgatgcaattgcataatcgctttcttttgtccgcaatgacttaaccgcttcatgtaaagcaacaagcgacgatgcacaagcggcatttacagacatgctttttccggtcaaaccgaatgtgtatgaaagccggttggagagcatagcttcgaaacttcctaaacaggcgtaactgtcgatttccgattcatgacctgtctgccggtagtcagaattcataatacccgcaaaaacagaagtggttttacgctggagatcccgcaaagagaccccggaatcttcgatgcaccgccaagtttcttctaaaaggattctttgctcaggatccatgtttttcgcttcccggggagagatattaaaaaacttatggtcgaaatggtcagctttatgaataaaacctccccacttgctgattgttttgttcggtatactgatatcagctgagtaataaagatcgggatcccaccgttcaatcggcacttcccggatggaatctttgccgctatttatgttttcccagaattcatgataatgatctgcatcggggaatctgcaagcaaccccgattatcgcgatatccgcactctgtttattcaaatgaaccattggcctccacccgcccctttttagtgtagaaataacgtatccaatctgcgtcttagcagactttcggtctcattcatcattttttcaccaatgtcatcgacatgtctgtttctccatgattccaactccgtgccctttacccaatggttaaaagcgcctaaagacgggccgcaatgaacttggaaattcaccttttgttcttcctccccttccaaagcaagcagacatcctctctgcaaataccacttaaatagtaacagcatcttatatttttgattgcgctccgctttttgggccaggttcggctgtttttctattatgctttcgtagatttcatcaaaagtcttattaaaataaacattttcgagctgaatctttgtctcttcatctatctcactcaaagactcatattgttggtagatttgaaataatttatttgccctgaccggaaacagcgtgccctttttcagcacctgaacctttgttccgaactcaaacagagtctccgaaggcgcataagcagtatcgcatatttctgtctcactcagcatttctttaacaaaaccgcttgttgcggcttcaactgtacattgattaatggatcccgtcataataaaatcagcgcccattaaaaaagcagacgccgcagactcgggagttccgattcctcccgcggccccgactctgatcttccttgcgtatttatgtgtttccatcatttcatcccgcaggttaacaaaaaacggcagcatcgccgtcaatgagccctgttcggtattactgccgcaatctgcttcaataatgatatcgtctgctgacggaacacggctgagccactccgcctgctcttccgtcagcataccgtgctgacacattctctttacgatactttggggaggcggactcagaaatgcggccgcaacttccggccgtgaaactttggcaatgatccgattatgaggtatgaccctgccgcttttgtccatcttcaactgatgcgctttgtaataaattaatggcgcgctgacggaaagatacgaagacgcttctattacccgtacgtcatgcttgatatataaatctatcaattccttttctctatcttgatgatccggctcaaatcgcagattcattccgtagggctggccatttttgagtgtctccttaatagaaataagggcctgttcaatttcccttatagttaaacccgctgtgccaaagaaccccagcattcctttcttcccgaggcggatcagcatttcagcggaagagatccctctatgcatcgcacctgccaaatacgcgtatgtcaaaccgtaatcttctttgaaagattgatcacccaatcgggacaccggtgaagccgcaacgctttctatattttcggccatgaggcccttctctttcccgctttcggaattgtccttgttcccttcagaaaacaagagactgtcttttggcgcactaatattaagcggttcctcatctctttgtatggtttgaattaatttagtcagaatgtttccgggaccgatctcttcaaacacagtgacgccttgtcccattaagtacctgatgctttcagtccatttcaccgagtttgttatttgttcaattaaattccgtttgatatcttcttgtttataaggtcttgccgtatagttagagatgaccgggaaattcaattcagaaaaatgaaactccccgataaattccgcaaattcacgctgtgcactttccatgaaacgagaatgaaaagctccgccgacttgcaatacgatataagctttcgccccttctttttcaaaaaaagaggctgcacgctttatctcttctgcagcccctgctatcacaatttgtgaagatgtattgtaattggcgatatctatttggccgaattcatacttttgaagtattttttttatgtgatgctcatccagtccgatcacggcagccattccgccctcggaagcctcactcattaactcgcctcttttagcaaccagccggagacctgtttcaaaattaaaaacaccggccgcaaaaagcgcagtatattcacccagactatgtcctgcaacagcatcagggcgagtatgaccttcttttaaaccctttaaatattgcagtgcgctcactgtataaattgcaggttgtgtatacttcgtatcagtgagcctctctttttcatctgaaaggcataaatcctttatggagtatcctaaaatatgatctgcctttttaatgagctcactgaattcatcgaataagtctctgcccattcctttaaactgcgctccctgtccgggaaagacgtaagcaagcatttgttttcctccttgttccgtatttctgccgtttcttttcgttccgattgtgatttgtttaacatttttcacttcaatttttaaaattgtcatttactctaagcacccggcaccattacttaataagcattacgaagcaaaataaaaaaacctttatgccggataaaggtttaaaagcaaaaagcatgtacaaagatcatattgccgcaaataatagatagaattttctgataattaaaaccgcattttcattctgttttttatatatcaatataataaaaacatcccaacgtgccgaaacaacgattggttttatgtgaatatttccctaaataaatactataccatgatttacatgttgtcaatgggaaacacacgtatataccaattcttcagccgccatttacaggcggctgaactcggttgttatcagttcatcagcccatgccgatatgccttcactatactattcgcggaataatagttctttctctttgttgtagtctttagtaaattgattgaactcatctgcttgtttatgcactttttcgtaaactgagtttactttgccgatttgctcttccagctgcgataatgtgagctttttatctttaatcagtttataaaggtcctgatcaagtgaaatggctttttcgtactttttgtacaaaagatcataagatgcataccttttttccattaaagcgacagcatgcccggctttttcttttactttcttatcctttatttcttgagaagttttttttgcggattcaaatgctttttttgaatcatcaatactgtctttttctgctttcagatgtttttttcgctgatttgcattgctcagagcctgatcagacagtgtgacgattttcttgtaatcatccatattcagtttaaccgcgctgtcgtaaagcttgtgctcttttttctccaatttttccaatgttttctgctctttttgaaacggtttttccgcttgaacggctttttccatcgagtcatgaagcgattcaaccggatcttttcccccgcagcccgcaagcagcatacttgcggcgccgagcgctccgattcctgctaatacctttttttgaatcatattcacttaaaatcccccaatcttgacaatttccactatagaagcccgaacgctttttgacaatagctgagctgtaattggcatgaccgggtaaaaagatgcttacggtgctgtcaaagaatacttgcgtaaaaaattgagaaaacagggcggatgaccatacatctttttggcttttacatagtttatagtagacgccggccctgctgacaaagggtcagcgtaattaaaagaggaggtttttttatgtacggatatggatttggcggcggatttggcggcggatttggcggcggttgctgcggcggatacggttatggcggttacggttatggctgcggcggcggatatggccgcacattcgcattaatcgtcgtattgtttatcttattaatcatcgtcggtgccgcttatttaggctgcggctgctgaccttatacaccatgaaaatcggccggcctgctatggccggccaattgtttcgttgcgccgcgataaagaaattcgctataatttacatattaagctttaggagtgaagtttcttgattactatggaaaatattgtacgcgacggacatcccgcgctcagagagatcgctgaagaggttcagcttcccgcttccgacgaagaaaaacagcatcttgctgatatgattgagtttgtgaaaaacagccaaaatcctgaattagccgagaaatacaagcttcgtccgggcgtcggtcttgccgctccgcaaacagacgtaaaaaaacggatgatcgccgtccatgcagaagatgcgaaaggcactttatacagctatgctctttttaaccctaaaatcgtcagccactcagtggaaaaaagctacttgacgagcggagaaggctgcctgtcggtagacgaacccattcccggctatgtgccgcgctacgcccgcatccgcgtaaaggcggtgacgcttgaaggagaacagattgacatccgcctcaaaggttttccggccatcgtgtttcagcacgaaatcgatcatctgaacggcgtgatgttttacgatcatatcgataaagaaaatccgttcaaagaacctgaaaacgccattgccattgaccgttaaaaaaaccggcacttcccaaagtgccggttttctttatttcaaaaggcccagttctttgacggcccagctgattccctcttcatccaccggctttgtgacgaaatcggcggcagcttttaattccggaaccgcatttcccatcgccaccccggtgccggcaaaacggatcatctcaaggtcatttagtccgtcgccgaatgcataagtgtcacttacgccgtacggaagccgctcaagcactcttttaatgccttccgcttttgaaccgcctttcggaagcacatccgttgacaattcatgccagcggacgtaatcaaactccggaaaagcggcatatgctttttcttcatgtccgcggcagaataaaagcagctgataaatttcttttcctttataaaatgtttcatcaacttcgggataaggcgctttcagactgccgataccttccgagacgtgcggatgtccggggacggtcgttttcatcgtgtcttccgccataaatacgacggggtgctccccttctgccgcctgctttaataaacgcgcaaccgcatcttcaggaagcggatttttataaatgacctcaccttcaaatacgacatactggccgttgtatgaaataaatgattcaatctcaagctcttccagaatcggttttaccataaacggggaccttccgctggcgataaaaacgtgatgtccagcctctttaagcgccgtcacggcgtttcttgcgctatcgggaatatgtttatcatggtcatagatcgtgccgtcaatatcaaaaaagatcagttttggtttcatgtcaatttctcctttttcccgtttatcagtcgtgtctttttcaatatcatcatacagaaagtttttcttccggaaaaccgccttgatgaaattccagttttacccacgaaaacaaattcattttttccgcatactactgctataaagggctttaaaggaggtatacgatgctgcgccgattacggaagaaactcagaagacagtggggcggaatgctccggaaaaaagtcatcgcatagaagggatctttcggtttttgaaagtcccttttttgctcgagactttccttataatccgttttcgaatataatagaatcagcgagtctaacatacggcatttaaggagagatttggatgatttataaggtattttatcaagagaaggctgacgaagtacctgttcgggaaaaaacagattcactttacattgagggcgtttcagaacgggacgtcagaacgaaactgaaagatcagaaatacaacattgaatttgttcagcctgtggacggtgcttttttagaatatgagaagcagagcgaaaattttaaagtattggagttatgagcggaatgaaatttgtaaaaaatgaccagactgccgttttcgccctcggcggattgggcgagatcgggaaaaatacgtacggggtgcagtttcaggatgaaattgtactgattgatgcgggaatcaagttcccggaagatgaacttctcggcattgattacgtaatccccgattacacgtatttagtaaaaaatgaagataaaattaaaggtctgtttatcacccacggtcatgaagaccatatcggcggtattccgtacctgctcagacaagtaaatattcccgtttacggcggtaaactcgcgatcggcttacttcggaataaacttgaagagcacgggctgttaagacagaccaaattaaacatcatcggtgaagacgacatcgtgaagttccgcaagacgtctgtatccttcttcagaacgacacacagcattccggattcatacggaatcgtcgtcaaaacaccgccgggcaatatcgtacataccggggactttaagttcgatttcacaccggtaggcgaaccggccaacttgacaaagatggctgaaatcgggaaagaaggcgttttgtgcctgctttctgacagtacaaacagtgaggtgcctgatttcaccatgtcagaacgccgcgtaggcgaaagcattcacgatattttccgaaaagtggacggcagaattatatttgcgacattcgcttcgaatatacaccgtcttcagcaggtgattgaagcagccgttttaaacggcagaaaagttgccgtattcggacgcagtatggaatcggctattgaaatcggacaaaatctcggttacattacctgtcctaaaaatacgtttattgagcataacgaaatcaatcgtatgcctgccaataaggtaacgattttatgtacggggagccaaggtgaaccgatggcggcgttatcacgcatcgctaacgggacgcaccggcagatttccattaatcccggagatacggtcgtcttttcttcctctccgatacccggaaacacaatcagcgtaagccgcaccatcaaccagctgtaccgtgcgggcgcagaagtcattcacggttcattgaatgacattcatacatccggacacggcggacaggaagagcagaaattaatgctccgcctgatcaaaccgaagttctttatgccgattcacggtgagtacagaatgcagaaaatgcacgtcaaactcgcgactgattgcggcatacctgaagaaaactgttttatcatggataatggcgaagtgctggccctcaaaggcgaagaagccgctgtggcaggcaaaattccgtcaggctccgtttacattgacggaagcggaatcggtgatatcggcaatatcgtgctccgcgaccgtcgcattctttcagaagaaggccttgttatcgttgttgtcagcatcaatatggacgactttaaggtttcggcgggacctgatttaatctcaagaggttttgtatatatgagagaatccggtgatttgatcaatgacgcgcagcagctcatttcaaaccatctggagaaagtaatggatcggaaaacaacgcagtggtccgaaattaaaaacgaaattaccgatacgcttgctccgttcctatacgaaaaaacaaaacgccgcccgatgatccttccgatcattatggaggtctaaaaaaactgcactcattacgagtgcagtttttttattgcagcggaatatgctgaaaggctttgacatcaaacagaccggccgccgtcattttaatatccggaatcaccggaagggctaaaaacgataaggtgagaaacggattgaaatcaccggtgaatccaagcagaggaagcttttcatgaagcacgcccaagctgtcattaacccattccgccgacttatcagacaaaagcccggcgatcggaagcggaacggagtgaagcaattctccgtttttcacggctgttaatccgcccccggtgtcacggagcttgttgattgcttttgccaaatcggcatcgtttgtaccgacggcgatgatattatgggaatcgtgagaaatggttgtggcgatggcgccttcttttaacccgaacccttgtacaatcccgagtcctatcattttttcgccgctgtgccgctctgcgacggcgatttttaataaatcattatctgtatcaggtcgaaacgcgtcagcagacggtgcaggcacttctttttttctcgtctccaaatgattcggtatcatttcgattacattcattttcctgccctcttgaatcggtatatgaaaatccgattcagtcagcggcgctttcagccgcactgtatccaacagtgcctggtccggcgaataggaaccggcagactgttcataaaccgtccgtccgttctcggcaacggtccggccggcgaccatggtcttcgtgacggcagcctcccgtacatctgaaatgaacagcagatctgcgtcaaaacccggcgctaccgccccttttgtttcaaggccgtagcactcagccgcatttaagctggcgagctgatacgcaaggaatggatcaagtcccgcctttatcgccattttgacttggtggttcacacttccttctgtaagcagatcatctacatgcttatcatccgtacaaaagaaaaagcggcgcgcgtttttttcattcaccgccggcagcacgttgagcgtattttttgccaccgatccttcgcgcagcatgacgtacattccccgtctgattctgtccagcgcttcttcttttgtcgtcacttcatgatcatttgacaccattgcggttctgtatatattgatgatatctgaagacagtccggctaaatgcccgtcgatccgctttccgtgacgcttggcatcaagcagtttctgaagcatatcctcttcaccttccgcaacagacacataatccattacttccgcaagcccgagcacctctttctcctgataaaaaggctttaaatcctcggcttttaatacagctcctgagcgttcaaagctagcggcgggaacacaggaaggaagcatgaaacggatgttcagcggcgcctttttcgcctgctctatcataaatgaaatgccttttgctccggaaacgttcgcaatttcgtgaggatcagtaatgacagtagtcactccgtgagggaggacggctttagcaaattcaatcggagtaaccatagaggactcgatatgaacatgtccgtcaataaagcccggaacgatcatttggccttctgcatcaatgacttcttccccttcatattcgcccagcccgacgatcactccgcccgtaatggcgatatctgcagaaatccattcctggttaaatacatccatgatttttccgtttttaatgacggtatcggctttttgtctgccggctgatgcattcagccgttcagccagtgtttctttgttcaaaatgcggcctcctctttttctttatatggtacaatatgctatcggatcgcctgatcatagtcaataaaaattgcagaatataccgcttacatgataaatgtctttctattctgacataataaaagaccgtccttttacggacggcttttcactttgtatgaagcactcttttttcaaatcgggaaatgtccgtaagagagccgataacgatgagaatatcttctttttggatcatttcagtcgccagcggagatacgatcacttctttttctctcttgatggccacgatattaatgccgtacttcgcccggatgtccagatcaagcagtgtgttgcccgcaagcctgctgttggccacgatctccacaatgctgtgttcgtcggacagctccaaataatcaagcacattatttgatacgatgttgtgggcgatgcgttttgccatgtcacgttcagggtggacgatgtgatcggccccgattttcgcaagtactttctcatgataatcgttctgcgctttaaccgtgatcgtgttcacgccgagttcctttaagatcagcgtcgttaaaatgctcgcctgtatattttcgccgattgccacaatgacgtggtcaaagttgcgcagccccaagtttttcagcaccgattcatcggttgaatcgccgatgaccgcgtgtgatgcgattttggcgtattcatttactttatcttcatcaatatccatcgccatgacctcaaggccttcttcacttaatgctttgcaaatacttccgccgaagcgtccgagaccgataacggcaaactcttttctcataacagtactcctttaaacaatatctctaataggaatagtatcacattttcggcaatgagttcatatagcgtttaagcttttctgaaaaggcgggtgataaatacaggtccgctccgcgttcgatttcttcctgatagtgacccggaggcgcaatttcctccgctttatcaagaaccagaaacgtcaggacgcctctgtatacacggccgccggcacacacttctatgaacgcgggacggtatgtgtgattatcaacaccttctcttttgtacagataggttgccgcttcaaacgggagcttgtacagcacgccttcagttcgtcccccgtcttcaacaagatcggctctggaaccgtcaggacgccttaacgtgaatctcgtcgaatacccttcaacaaccgcccctccgaccggctcggcaaagaagtggtcgacccccgcctgtttaaaccgggcattgtccatacaggagccgtaagcgaaataataaaccggactgtcatcctcccgtttcataaaacggtattctttccagtctccgcttttgatacggctgaatgaggcacactggccgggctttacgacatatgcgaaggcggttttattcccggcatccgtcgtcacggcaacctctttccggtcaaaatcagcataatacatatccagcttacggatcatctgatgatctgtttcatacaattccccgtacacaaaagctgtttctgctaaagacgccgcaggctgacctttatccgtttcgtacagcacaccgtttatcgcggcctgctcgcacacacatagagcgcctttcagcagttcatggttttcttcacgcttccgtaacaaaccgtatacaaaaagaagcaagttatttttcctccttttggacagcagccgcttctaacggcagaatcacctgaaacgtactgccttctccatttttgctcttaatgttaagtttaccattatgctccttcagaattcgtaaacaaatcggaagcccgagacccgttccctgatcttttgtggagaaaaacggtttcccgatattttcaagcttttctttcgacatgccgtttccttcatcctgtatgctgatcaccgcgtattcttcatcccgttctgtataaatatgaatattcccgccgtcaggcatcgcttcaatcgcatttttaataatattgataaatacctgtttcagctggttttcgtcaccgttgaccatacaggactcagtctgcctgaaatccttctcaatcacagtgttcgacagcaccgcgttcgtgtcaagaagcgtcgccacctgccttaaaatatggttgagatgatgagcggtaaacgtcacggtctgcggcttggcgagcagaagcagctcccccagcacgagatcaatccttttaatctccgaaaaaataatatcgaaataatccgttctttccggatactgggctttcatcagctggagaaagccgctgactgacgttaaaggatttcttacttcatgggcgattcctgccgcaagctccccggcaatggccagcttttgagattgcatggcaaggcgttcgttcgtttccagaagctcgtcgaccgcttttttccgttcactgatatcagacatcgtccccaggctcccgacaaatttctgtctgcggtcataatacagcttataatggacttctccccaaaagatcgtgccgtctcttttaatatatttggccgtaaacattcctgacggggactgctgcttgatttgggagataatataatcaatgatatgtttttcttttataaaataatcattatacatcgtgcccatacattcgctgatggagtggcccgtaatcgtcgtccaggcctgattcaaatatgtaatattcccttgtgaatccgtctgaaaaacgatttcctgcagattgtccatgatccggtttttctcatctgaaagcgcctttgctttctgctcgctgtccttcagctccgccagcagctgctttttattgtccacataataagccagcagccagacgctgattaatgtgacggcggtaaaggtgatgtcaacgggccagttaatcggattccgttcaatcatataaaataaataatcccaaaacataataaaaatcattgccaagattaaggaaatgatacgcgcttgatattttcccatagtcccacctgccgctaacatttctacatatattgtaacattgttgactgcattattgactaaaaaatgataactattcccaattaattgagcaggttcgcttacttttcccgtgagtttttgcacaagttcataataaaaggacggaatgatgccccgccctttttgctgattatgatctatcttttaacgcttcttcgatttcctcaagcagcattttcgctccttcaggacttaaaataattttgccgttgccgtactcctgattttcggaggtaatttccccggtcatcaagcaaatgccgtgcggcttgtatttttttaagacaattttgtctccgtcaacgaaaaattcaatactatctttaatagcgatatccaatgctcttcgcaattcaatcggcatgacaatacgcccgagttcgtctacttttcttactacaccaattgatttcatagaaatcccctacttcctttaatgtctcttctttatgtccaaggaaaatccttcataaacgtagacgaaaggaacggagcaaaagtttctcagcatccggaaatgaatgttttttacaaaagaaagccttttgaaatacgggatacagactttccctccttttttacaaaaacatttcattcccggcggaaacccccaaaaatcgtggtttttctcagaaactttaaatgtagaatcaattaaatcaggatagggattgggtgaaaacatgtttcaatcaactgagatcggaatcgacttaggaaccgctaatatacttgtttacagtaaaaataaaggaattattttaaatgagccttccgttgtcgctgtagatacaacaacgaaagcggtgcttgccatcggaacggatgccaaaagcatgatcggaaagacgccggggaaaatcgtcgccgtacggccgatgaaagacggtgtcattgctgattatgatatgacaactgacttattaaaacacattatgaaaaaagccggaaaaaaaatcggaatgaccttccgcaaaccgaatgtcgtcgtctgcacgccttcaggctcaacggccgttgaacgccgcgccatcagtgacgctgtcaaaaactgcggagcgaaaaacgttcacttgattgaagaacccgtagccgctgcaatcggggccgacctccctgttgacgagccggtcgcaaacgtcgtcgtagatatcggcggcggtacgactgaagtcgccatcatctcattcgggggcgtcgtatcctgccactcgatcagaatcggcggcgaccagcttgatgaagatatcgcctcgttcgtcagaaaaaaatacaacctgctgatcggggaacgcacggcagaacaagtgaaaatggaaatcggatttgcattgatcgaacatgtgccggaaacgatggaaatccgcgggcgtgacctcgtaaccggtctgccgaagacaatcagactgcagtctaatgaaattcagcacgcgatgcgtgagtcgctcctgcatattcttgaagcgatcagagcgacgcttgaagattgtccgccggagctcagcggtgatatcgttgaccgcggcgtcgtgttaaccggcggaggctcccttttaaacgggatgaaagaatggctgacagatgaaatcgtcgttcccgttcatttggcggcaaatccgcttgaatcagtggctatcggcactggacgttcattagacgtcatcgacaagctgcaaaaagcgattaaataataagattgtgcttcttttttctccggccggctcatattgtgagaactggagaaacattaaggaggaagcatatgcttagagatgtgggaagacgcgtagcagtagccgtcattttaagcggaattattttggggggtatgagcatttcactggccaatatgccccattctccggccggcggcgccgtaaaactgaatcatccgtaaagacgcagcaaaagctgtgtctttttcgtttgtgctccttcctttcctttatgaggcgatatttgatatgatgagaaaaaccgatgaggaggaatgaacgatgagttcgtttactgaaaagttaaatacatatgctcagctggcggtagaagtcggcgtcaatgtccaaaaaggacagcatgtcgtaatcaatgcctcaactgatgtccgggaacttgtcagactgcttgccaaacattcttatgaaaaaggcgcaaaaaacgtcaccgtaaattggcaggacgatgaactgtccagattaaaatacgagatggcaccttttgaagcgtttgaagagtatcctgaatgggaagcaaaaggaaaagaagagctcgcgaaaaaaggggctgcgtttatttctgtcgtctcatccgaccccgacctgttaaaaggcgctgacggcaaacggattgcagcgttccaaaaagccgccggaaaagcattgcatacatacagacaatatattcaatcagataaggtcagctggacggtgatcggagcggcttcaacaggctgggcgaaaaaagtgttcccggatcagccggaagaaacagccgttcagcttttatgggaagaaattttcaaaacaacccgcgtaaatgaagaaaaccctgtggcagcatggaaaaaacacgatcaaaatcttcatgaaaaagtggaacacctgaacaaaaaacattacagcgccctgcattatcaggctgaaggaacagacttaaccattgaactgccgaaaaaacatgtatgggcaggcgcgggaagcgtgaatgaaagcgggcacgaattcatggccaacatgccgacagaagaggttttcacccttccgcagcgtgacggggtgaacggcacggtttccagcacgaaaccgcttagctacggcggcaacattattgataacttcactcttacctttgaaaacgggcgcattgtcgatgtgaaagctgaaaaaggcgaggagattttaaaaggcatcgtcgaaaccgatgaaggctcacactatctcggtgaagtggccttagtgccgtacgattcaccgatttcacaatcaaatattttattttacaacacactgtacgatgaaaacgcctctaaccacttggcgatcggcagtgcgtatgcctttaatattgagggcggcaaacaaatgacacgggaagagcttgtcaaagagggcttaaatgaaagcattacacacgtagattttatggtcggttccaaagaaatgaatatcgacggcattaccgcggacggcaaaagagaaccgatcttcagaaacggaaactgggcattttaataaaaaaaaggaggcgatcaggcctcctttttatttcgcttcatacatttgcaagttggcgaagacggtttccaaaacaggtgtatcaattgacaagcctttcgctttctcaagcaaaaagccgtgtaaatgatcaccttccgtcaccctgcccttttccatatctctcagcatcgacgatttcatatggtaagacatgcttgtcaatgtgcgataactctcttcttccagaccaggatctttcgggatgccggcagccttgaaaatggctccgatttcagcaaagaggcgctttgccgtgctgcggccgccttctgtttctaaaatcggtccgaccggctgttgaaacagagtggtcactcccgcctgcgcggcaataaacatatattttttccaaatgtccttttcaatatccccgctgatgatgacatccgctttcacgcctgcaaatgcgttttccagctcattcatacgttctgtgcgctccccgttccattcaccgaaaacaaaacggtgggcagcgctcgtatgaagaatttcccctttgtcgttaagggcgctctcaataaagcagaggccgcccagcacctgccgttttgaaaaagcttcaaacagctggttatagtgcctgtatccgtttaaaaaaggaataatgaccgacgaaggcttgacaaacggtttgacatcccgaatgacgtcctgcaaagaatacgcttttgaagcgatgataacggcgtcaaatgctccttcttcgcccgccaacattaatttcggcttgattgaaacatcaccttttgcacttttgacggtcaaacccgtttcttgtaattgttccgcccgtttcttgcggacgagaaatgtaacgtcatttcccttttctgcaagacgcgcgccgatatatccgcccactcccccagctccgacaactaaaaacttcatgatgcattcctccgtctcttttcaatttatgtattcctttattgtaatgggaagtcagaagattgaaaacttttttcataaataaaaaagcagagtctcccctgcttctttattacgcgtatagctcttcaagctttttctgcacatccgcgttttcaagaaattcgtcataagacatttgtttgtcaacaatgcctttaggcgttaattcaatgatgcgattggcaattgtctgtacaaactgatggtcatgagatgaaaacagcatagcgcctttaaagctgattaagccgttgttaagcgctgtaatggattccaaatctaagtggtttgtcggttcatccagaattaagatattcgcgccggaaagcatcgcttttgaaagcatgcagcgtactttttctcctccggaaaggacgtttgattttttgttgacttcttctcctgagaacagcatgcgtcctaagaaaccgcgcagaaagctttcgctttggtcatgcggcgagtattggcggagccagtcgacaaggttcgcatcgctgccgtcaaaatattcgctgttgtctttagggaagtacgcctgagaagtggtcacgccccatttaaatgtgccgctgtctgcttccatttccccggaaatgattttaaacaatgtcgtaacggcaagttcgttgcggcccgtaaatgcgattttgtcttctctgttcataataaagctgacgttatcaagcaccttaaccccgtcaatcgtttttgttaagccttcaacccgcagcacgtcatttccgatctcgcgttccggcgtgaaattgacataaggataacggcgtgatgacggtttgatatcatcaagcgtgattttatcaaggagtttctttcttgatgtcgcctgctttgatttagaggcgttggcgctgaatctggccacgaactcctgaagctgtttaatctgctcttcttttttcttgttggcttcctgagaaagctttaaagcaagctggcttgattcataccagaaatcatagttgccgacgtacacttgaattttattaaaatcaagatcggcgatgtgcgtgcacactttatttaaaaagtgacggtcatgggatacgacgataactgtgttctcaaagttgattaaaaactcttccagccactgaatcgctttcagatccaagtggttggtcggttcatcaagcagcagaacgtccggcttgccgaacagcgcctgtgccaaaagcactttcaccttttctgaaccgcctaagtcggccattttcttcgtatgcaggtcttcagagatgcccagcccctttaacaaaatagcggcttcactttcagcttcccatccgtttaattccgcaaactctccttcaagctcagcggcgcggatgccgtcttcatctgaaaaatcaggcttcatataaatcgcgtctttttcctgcatgacttcgtataaacgtttatgtcccataatgacgactttcagcacttcgcagtcttcatattcaaagtggttctgcttcagaatggcaagacgttcgcccggactcatatggacatcgccggtctgaggctccagctcaccggataaaattttcaaaaatgttgattttccggcaccgtttgcgcctattaatccgtagcagttgcccggcgtaaatttaatattgacatcttcaaataacttgcgatccgcaaaacgcaagctcacattatttacagcaatcatttagaatcctccatcgtgtctatcatcattaaaagtataccatgaataaaggggaagagaaatgtttccctgcgaatatacgggtttgaaaagatgcaggcgtcaaacccggagcgctgtgatacaatagatatatatacatattcatcacggaggaacaagttgaagcttttaacactcacagaatactgtcttatgattttcttcaccggggtttttctggccgtcacaggctttacggcacgtgacatcggcttgtacgtcggaatcgccctcatttatacgttttcgcatctcttttccaaacggatgcttgaaagacgcggcaaagagaagaagcaggtgaatctttttttcagcgttctggccattgtcggatcagtgctggccacggtattgttcatcgccgtcgcggcctcgtttgccaaataaaaacgcctgctgtccgaatcgggcagcgcggcgtttttattttgtctgacgcatatcatgaaacgggaagaacacaaacttcgaggtgccgacgatccggttttcggcaattaagccgaggccgttccggctgtccattgagttcagccgattgtcgcccatgacaaagtatttgcctttcggaacctttacggggccgaaatctcccgtcaggttgactcccagttttttcgcttcttttttattgctcgcgaggtacggttctgcgatttttttgccgtttatgtaaagcgtgtcatttttcatttccaccgtttctcccggttttccgatgagccgctttacataatggactttcgatgtatcgccgttaataatgacgatgtccccccgctcgatttctccgatataattgacgcttttgttgacaaacagtctttcaccgtcatgtaatgtcgggtacattgatgatccttccactaagtacggttcaaacaggaaatggcggattaacagcgcaagtgcaaccgctataatgatggcctttccccattcccaatacgtgttggattttctttttaccgatttttcagaagtaggtttttgttcttcagtcaacgtggttcctcctagacgatcactgtttcggttcatgtaccatctttactttatcacaactcatcacaaaatacataacgcttctatgcgtatatgattgaaaaaagcgcccgtaaaggacgcttttcgcttatttctctactaccggttttttgatgattcccaagataaccgccgttacaatcgctccgatcacgatgctcattaagtaaagcagcggatggttcgtaatgaatgcaacgaatatccctccgtgcggtgcaggaagcgttacccggaaaaactctgtcagtccgcccgctaccgcagaaccgacaacggctgcagggatgacgcgaagcggatcagccgctgcaaacgggatggcgccttctgtaacgaaagctgctcccatgaagtagcacgtaataccggcttcacggtcacgtttagagaatttgtgtttaaagaatgttgtcgccagtgcgattccaagcggcggagccattccgcccgccatgatggccgcatgcggcgcatagtttccggcatcgatcatcgcgataccgaaagtgaacgccgctttattgagcgggccgcccatgtcgatagccatcataccgcctaaaataatacccattaagacaaggtttccagttccaaggctttcaagccaatttgttaagaaattcataaacgctgctacaggtgtgttaatgacaaactgcatcaggacaccggtgataaaaataccgagcagcggataaatcaatacaggttttaatccgtcaagagtctgaggaataaagacaaacagctttttcaaaaggactacgacataaccggctaagaatcccgcaatcagtccgcccaagaatccggcattcgcctgcgtagccataaatccgccgaccatacccggcgcaaatcccggacggtccgcaatactcattgcgatgaatccggcaagtactgcaacaatcagctttaacgcattaccgtcaccgataaagttcagcgctgcagcaaacgtgttgtatgtcgggtctttcggatcagctgaatgaattccccagaagaatgaaatcgcaacgagaattccgccgccgacgacaaatggcagcatgttgctgacaccgctcattaagtgtttatagaaagtacttccgatgcttgtgcctgatttctgtttcggaccgtcttcatttgaagcggaagatcctccgccgctgccctcgtaaatcggcgcatcttggttaacggctttttcaatcagttcctgtggacgtctgataccggccgtcacaggcacttgaagaacatgtttgcctttaaagcgctccatttcaacctgtttatcagccgccacgataatcgcaggcgcgtcttcaatttcttgagccgtcagcttatgtttaataccgcttgagccgtttgtctcgactttaatgtcaacgccgagctctttcgctttttctttcagtgcgtcagctgccatgaacgtatgagcgatacctgtcgggcatgccgtaaccgcaaggattttcccttttcctgacggcgctgcctgttcttcctgctcttcttcttcctcatcgtcatctttgtcatgctgattgatgatgtcaatgatcgcatcttctgattcagcttcaagaagctgtttgcggatttcctcacgcataagaagcgttgaaagtcttgataatgcctcaaggtgcgtattgttcgctccttcggttgccgcaatcataaagaccaagtgtgccggctgaccgtctaatgattcataatccacaccatcttttgaacggccgaatgcaatggccgggttaatgacgctcgccgtcttcgcgtgaggaatggcaataccttcgccgattcccgtcgagctttggctttcacgatttaaaatggctgctttgtaagcctctctgtcatttaatctgccggctttgtcaagcactgtcaccatttcatcgataacgttttctttctctttgctttctatattgagatgaattgtatctcttgttaacagctcagttatcttcacttttctttcctcctctatagacgtgtgactttaacttcaggaagaagctgctgtacaaactcttcagttccgagttcttcagaaaatgccgtcgcgcttccggaagcaactcctaaacggaacgcatcttccaaaggcagctgttttgaaattcccgcaaggaatcccgcgacgacggaatcacctgcgcctaccgaattgacaagctttcctttaggaacattggcgaggaaaaccgcctctttcgtaaataaaagcgcaccgtcgccagccatcgaaacaatcgcgtgttcagcgccttgttcaattaattttttaccgtaaggaacggcagcttcggctgaatcaatgaccgtattgaacatttccccaagctcatgatgattcggcttcatcaaaaacggtttcatttctgtcgctttcatcagcgcttcaccggagatgtccaccactacccgggcattctgctttctgcatgcctcagcaattttttcatacgtgttatgcggcagggaagaagggatgcttcccgctaaaacgacgatgtctccctcttccagagcggagaactgttctaaaaaggcattgaacacttcgtctgaaatcgtcgggccctgtccgttaatttccgtttcatcgcccgttttcagttttacatttatacgcgtgtcttcatccacctcagaaaaagccgtttccagaccttcctgctgcaaaaatgacgtgatataatttccggtaaatccgccgacaaaccccaatgcttttgacggcacatggtgtcttttcagtaatctcgaaacgttgatgccttttccgccgggatacttcgtgtcatagctggaacggtttaaaccgcctacggcaaaatcttcaacgtgaacgatatagtcaacagacggattgagagttacagtgtaaatcatggtttcactacctttacgacagttttttcttggtaatcatcgaatgcaagttcttcagcttcagtggtaatgatagctgcatcgcccaaggcggcgaacgctgcgaaagaaatctcgccgaatttagaaggatcggctaaaacatacgcatttttcgcctgtctcacagcctttgtcttcagaagagcctcatccggatcgggtgttgtaaagccggcttcaatgtgcacgccgttcaccccgagaaagcttttgtcaaaacggtactggctgaccgccgttaatgaggcgccgccgatcatcgcacctgttctatgcttcacatatcctccgagaagataaaaaggaatccccttccttattaaagcatcgatatgcataaccccgtttgtgacaaccacaatgtcctttgtatgatctataaaatcaatcatgtgcaatgtagttgttcccgcatcaaggtaaatacagtcaccttcttctaataaagatgccgcttcttcagcgatcttcagtttatcctgaaggtttttggaggatttttcaagcatatcgggttcttgcctgctgttggaaagtttagacgccccgccgtgaacgcgctttaaaaatccgcgctcttcaagtgttgataaatctcttctgatcgttgattcagaagcgtttgtcatgcttatcagctcttgaatcttcaccacatctcgcttttcaatctgatccataatcagctgatacctttcaggagtgagcatattccgcctcctttgaaaacgtattcatttcggctgcaagataattgtaaacgctttttttacttcaagcaactaaaatcactcaaattcattcaataactatcaaaatctttcacatttgttcatattaacgtatgtacatagggtttgtaaactgtaaattcgacaaaaagggggacaattgtatgacattttctttttatcataaatgaaaaaagtctattatattcattcaatcattaaaacacaaaaaaccccatgcagactgcatggggcgccggttattcataccgtaacgcttcaatcggatctaagcgtgatgctttgttggcgggcagcatgccgaagatgacgccaatcagcatactgaacagcacgccgatacaaaccacctgccaggaaacgagcgacggccagcctgcgataagggaaacgagtgttgctcccccgtagccgagaccgattccgattaagccgccgattaaagtaagcacaacagattcaattaagaattgtgtcagaatctgtcctctcgtggcaccgagcgatttgcggatgccgatttctcttgtccgttccgtcactgatacgagcataatattcatgaccccgatcccgccgacaacgagagaaataccggcgatcgaaccgatgatcgtcgtcataacggtcgtgacctgaccgattcccgccgcgatttcttccatattcatgacttgataggcctcttttgtaccgtgattgtcatttaagagacgggccgcttcttttcctgttgttttgatttgatcagcggactccgtctgaacggaaacgttgctgtagtcgttagtaccgaaagacgttttcagcatgttgaacggcacatacatttcactgagtcctaacgataaaaagccgctctcttctttcagtacgccgattacttctacgggctgtccgccggcccagacgattttcccgagcggagacgttttcccgaacagcttttcagccatttttttcgagatgattcccgctcttttcccggaaagaaaatcattgtccgtaaacgtccgtccatcttgaacgtccagcttttttacgtccaagtagccgctgttaatgccgttcagcgtaatatccgtgtcttcttcatggtaacgggccgtcatggattttaccgcggaagcgacaacctgctttacgccgtccactccttttaatccattaatatcttcttctgtaaaactcgcttgctgtaaggcgttcggattggctgttaattcttcatcactgggcatgtaaaacaattcaatcgtattgcccggcccgctgatggattgcttcagcatttgctctccgccctggccgacagccacaacaacgattactgaaccgacgccgataatgattccgagcattgtcagaatcgatctcagcttgtgagctcttacggaactgagggccatccggagattttctgacaggctcattcccccactctcctctgctcagaatcgcgggaaacgatcatgccgtcacggacgaaaatcactctgtttgtacagtccgccacttcaggctcatgagtgacaagaaccacggtcacgccctctgcattaagctctgtgaactgctccataatggaaatgcttgttttcgtatccagcgcgccggtcggttcatcagctaaaatgagcttcggttcgttcacgatggctcttgcaatcgcgacacgctgcttctggccgccggacagctcattcggcatgtgacgcatccgatccgccaaaccgactttttccagcgcgtgctcagcccgttcctcacgctcttttttgccgataccggcgtagatcatgggaagttcgacattttttcttgcattcaatcgcggcagcagctgaaactgctgaaagacaaaaccgattgatttgttccggaccgccgcaagctctttttcggtgcatgaagaaacatcttcgcccgcaagactgtaattgccggacgtcggtctgtccagacagccgatgatattcatgatcgtagattttcccgatcccgagggtcccataattgacacatattctccttcttcaatcgtcaggtcgattgaacggagaacatcaaacgtctccttgccgatctgatagctttttttcacctttgaaagctgaatcatctatgctttcacatccgttccgtcagtcaaaccgtcagccggattcagaatgactttatcatcctttgaaagcccctcttttatctccgtaagctgatttgcggtatcgccgactttaactttcacgcgtttggccttcccgtcttttaccgtaaagacccagtgctcatctccgtcttttttgactgcggaggacggcagcgtgtcggctttccgtttgtcggtttcaatgttcataattaatttaaatcccggcttgccttccggaaggtttccgatcagcttaacctgaaacggatactggacggcttgttccgtgctttcccccgaagcagcgcttgacttttgatccggaacgaggccgacagccgccactctccctttccacgttttaccggggatggcgtctgaggtgattgtaacgctttggccctttttcactttcagcgtgtcgtattcggacaaattgccggcaacgaccaggtgttccgggtctcctatatgtataaccggttcttgaatatccgattttttagaagccgcttcttgatttaccgagataaccgtcccgtccatctcactcttaacattgagattcgacacttgattttcaagagactgcttttgcaaatcagattgctttaattcgatttccgccgttttttgctgaagctgcagatcagtccgttcggattcaatttgttttttggcttccgcttctcccacttgttttgccagatcttgttccttgctgtttaatgctctgagtttttcttcaacttgttcgatttgcatccgttttgattgttctgtcaactcattttgttctttatcaaggttgagctgctcatttgtatacgtgactaacgacgaccctttttttactttgtcgccttcttttactttcactttatcaagagttcctttatctgcttcataaaaaacatactgttctttagaaaatttaagtgttcccggaaccataaccgtagatgagatttctctgttttccatggttccggtttcgattttttttccggcgctgccgcccgcgggagcggcagacttataaatattgataccgataaatactgcaacaattacggcgatgccgattccgatccaaatttttttcatgttatacacctgctgtcactgaacttaacagtcctccgactgccgaaaccaaaagcataataacaaacaggacaatcgcggaagtccaggccgcttttttcgaaatgccgcctgtatagcgaagtcccaaagccagcagaatatagctccagatgctgaaaatgtcgaacgcgcttaaaaagaccgcgacgccgtctccggccggtatgacactcgccaaagatgtaacggcgtacaatgagcccgcaccggtaaaataagtgacaagaccgttaataactaagccgatattggtaataaacgccgtaaacaggctgagtgagagcatttttttgtaagttgtcacgccgcctgacattttgacgcacagccagtaaatgagcggaacgataaacagagcgataatgcccccgaagattcctccgaacatcgtgccgaatttagcgaaggttttggtcatttcaatctgatcatccgtcaaaccgtcaagagatgagctgttcagcacttcttcataattcatccccagtccgcgcaaaatactgccggccgcgatgagaatgatgacaatcaggagaggtatgccgatgaccggcttttcttttaatcttttaaactgcacaacaggacttgtaatgacgccgaaaattgacggcttttccgtgactgccgcattgcttttttccaggtttggttccatatagctgatgcctcctatgtattattctgtttatacgtacgctttaggctgagagaagtttcaatttttttgccgtttgcgtatttatgctaaattgtaacacaaattctcagctttacgttccataattatgtaaaaaaaagcatcgtcagaccggtatgacgggtaactcaaaaccttgtaaaggcactgttatcagcctattcatgcagtgaaaaccgcctcaattgcaaaaccctttaaatcccatttagatattctctgaaattcagcgcctataaacaaaaaagccggatggcaatgatgcacatccggctcttttttcaccctccgcttacaggagggataaaggcaatggtatcaccttctgttacggtgctgttgtcttttacatatgtttcattgattgcgatcatggcattgtcaatcgtctgaaggccgtaccgttcctttaacagcgtttttacagcagacgctgccgtctctttttcgtcaagttcaatgaccggtgttcccgcctgctccgcaagcccggcaaataataatactttaatcatcgcgattcccctttatccaaatccggttttccgttcggatagggcgttgtttccagctgatcgcctatccattcttccccgtcttcccagatttcttttttccatatcggcacaatctgttttatccgttcaattgcatattcattcgcctcatatgccgcctttctgtgcggagaagacacagcgattacgaccgctgcttcaccgatatcaaggacgccgacacggtgagtgattgcagcttcggctccttcccatttcgcgctgatttcactgccgatttgagaaagcatttgaacagccatcggttcatacgcttcatattcgagacgcaccgtccgccgtcctgcagtccactctctgaccgtgccgataaacgttgtgatggccccggcttcacgcttttcaactttttttacgatattttccgcaatgataggttcccttgtaatttgaaaacgttccatttaagcagtttcccctttcagctgcgaaagcacaaacataatggcagcaggatcgtccgcatggaatacgggcttgcccgcatctgccggcatatgctccgtatttctgctgacaaccgcgatcacgcgctccaaatgcttcagcttttgccaatcttcgctgtttttgatcataatgattttcggatgcggcgcatgtttaaatccctctatgagaagaccgtcaattcccagacattcatacagactgatcaaacccgccagatcccatttttttcgcgccgtaagctgcaggacgccgtccccttctactgccgtaaccgcggctccggcttttgaaaaacgctccgagtcttttccgtcagaaaaaggttccggttctccgccatgtccgtgatgttttaaacatccaatatcgcactctttcggcgcagctttcagcacacgttcaataaacgttgttttaccgctgttttgaaaacctacgatctggacgatcgggaaagaattgaccacggccattcacttccattctcatcacggatgaggagcgcgtgaaccgtccggcccgcttcataccccctcgttcctcccggcagaaggataaacgcgtttgcttcggcaagagatgtgactgagcttgatttgtcgagaccgaccggtgacgccatcatttttccgtccttatgataaacaaatgccctcacaaatctcgtaaacggattcggcttcggaaagtcgtttgttaacacggcttccgcccatccggaatgaggtttttcattcagaagccatgtctgaatcatcggtttgacaaacagggtgaatccgacataacatgcggacggattgcctgaaaggccgaacagcagcatgtcatcggcccgggcgacagttgtcacgctccccgggcgcattgccactttgttaaaaagaacttccgctccgagcttattataaatgtccggaagaaaatcaaaatcgccgactgacacgccgccggtcgtgatcagaaaatcaacttttttcatagcttccttcaccgcagcatagctgtcatcaaaatcatcggaaattttccctaagttcagcggtactgcacccgcttcaatgacctgggcatacaccatggcagcgttgctgttgcggattttccccggctcaagcggatcgctgacatgaagaagctcggttcccgttgcgataatgccgacaaccggctttctgaccacgggaacggaagcatagccgaaggttgctaaaagagcggttacgcccggcgtgattttcgtccctttttttaatagcgagctgccttttttcgcatcttctccttgatatgaaatattatcgcccgcatgaaaagggcgtttcactgacatgtaattcgtgccgttttcagaaaacgtttttgtcagctcaagcatcactacagcatccgcgcctttgggaatctgcgcccccgtcataatgcggaccgcttcataaggcccgagttctttttctgacacggcgccggctccgatatggtcaatgacttcaaaggtgacggcattgtcacgggaagccgtttttgaatcgctcgccctgatggcaaacccgtcatacggagaacggttaaaagccggcacatcatgatccgccttaacatcctccgccaaatagcggtggagactgtcctcaagcgccacccattcggtatcccccttttttttataccggctcacccggcggactgcttcgtccacctgaatcggcgttcttttttcaagcatagcaatacatccccttcctacagtccgatcactctggccagaactgaattcgcttcttttatatcgtttgtaccgtgaatcagagcccgtccgtcctgaaaaataacgattctgaagcgctcgtacgccatgtgcagcaaaaattcatttgcttccactttaccgatctgcttcagacgtttgacaagctcttctttatccagcctctttaaggcttccgatctgatttgaacggtgtctcttccgcacagcacgcttgctttcggcctgttttcaggctgcagatacggatatacgggctccgcgccgcaggaagggcaatgatcccgtttgatctgatccacatttatgctcatattggtgttattccacacgtcaaacgtgaaaaagcgccgatttaccgccgcatgatttcctgtcagcaatttcagcgcctcagcctgctgataggcggagacgatatgaaccgccggaggtatgatgcctgctgtatcacatgtcgctccgcccacgggcatttgctcaaacaggcaggataaacacggcgtaacccccggaataatcgtcatgcacattccctgactgctgacacaggcaccgtaaatccaaggtgttttcgttttcagcgccagatcattgatgaccattctcgtttcaaaattatctgtcgcatccacaatgcaatccgcttgttcgatcagcggttcgagcgtttccgccgtaccttccgccgcgtaagcatcgatatgtatattactgtttaccgctaaaagacgcgccttggccgccattgctttcggcaggcgctgtctcgcgtcttcttctgtatacagctgctgtctttgtaaattgctccattccacataatcccggtcaataatcgccatacggcccgctccggctcttgcaaggccctctgccgcggctgttccgagggctccggctccgacaatcaggacactgctgtcagccagcgcctgctgccctttttcccctatcggcttaaatcttgtctgccgtgaatagcgctcttccatctgtgttgtccccttgcatttttatttccatcataccatgtttcttaccgatcagtcctgatttgaagactcgacatgcgccaaaagtctggtgtaatcgtcccgtgtgttgatattagcgaactcctccggcccggcgccgatgtcttcagcctgcacataacagacagacagccgtttcagcgtgtctgtcattttcagtttgttttgtgtcagctgatcaaaaagcacatcctgcacccgtttatggtaaaccgccaagaggggctgctctctgttttcacaaaccggtatgacagcgtccagatttcccgtcagcttcatttcaagcgcagccatcgtttttcttgtcacgagcggcgtgtcacaggatatgaccgtatatgtttcgccttccgtttgtttcattgccgtatatatgccggcaagcgggcccattccccgaaaccgcggctcatcggcaaaaacatgccgctccctgtttgataagaacttttttatatgctcagggcggctgataattaccgtttctccgccgccgaaggcttttttcgcctgttcataaaacatgccgcccttccactttgcaaaagctttcggttctccgaatcttcgggaagctccccccgctaatattacattcacccgtttcatgtcatcgctctcccattctatataaaagcatagcaaacgcctcagccgaaatacaatattacggtgcttgtctgtttaattaagaggaatagccgttgttcctttcccatattgtagtgttaacatcaagagggagatggttcttatgaaaatatcaggtccgtttttccacgacacttctcaagagaacctttacttgaaatccgaactttccagatgcagaaaaataatttcggaatttgaagcaagctacttccatcaaaaaaacaataagcttcaggaggaaaacgccaatattaaagagcggcttcacaagctttctgacgaattggaagccatggcgcaaaaacacaaacagactagtgacacggaacgttctttgcatgaaatcagggccgggctgctcgataaaatcgtcattctgcaagaactgcttcagcaggaaacgtttcggcggaaaaatgagatggaagaaaaacatcggctgcatcttacaaatgtaaaatttgaagaagaaaataaaaacttacatacccgcatccgctcacttgagaccgccgttcaaaccgaacggacttctcacgaagatatgaaacagcgttatcatgccgctgcagacgaaaatacccggctccaaacacaaatgatagaaaaagaataccagctcaaacatattaaaatagaaattaatcatatgagagatcgaatactagaaacaaaagaacggcttgtagaaatagaaaaaacgaaagaaaagttatttcaagaaaccattctttcatataaacggcagcttgacgaaagcgatgcttggattgccggccattttgctgatattgacagccgcacggcggaaccggcggaacaaactctggaaatcccttccgtttccaaagagactgttcaggcagaagacttgcttacagccgttaccgaacaagtcatctcccttcaaaaacaatttgtagaatcagagtcccgcgatcagtcgtttgatgaaaaactggatgcgttgaaagaacgagctgacggcgaaaagcctttccaaaaatatgttgtcaagcttgaaaaaaagcctggaaaagatgcgtcacttccgcagaataaacgggaaaacgcaaaaaaactgcttgagtaacgcaagcagtttttactgttttattcagcagccgtatcatttgccgtttctgctgtttcctgagaaatttctccctcaagaatatattggccgcgatatggttttttcacttccggatacattttaattaagctttgcataaatgttgtcatattaggaatttcaaggccgctttccttttcaatttccttttgcagttcggaacttttgatcgctgcattgtggcgtttcaatgttttaatcgctgcttcgcgcagttttgccgcttttgatcccggtctcgccgtccctcttcttcttcttgtagaaccgtctggaatgccggcgggaagagacgtaatagactgcatctgcggctgggaggattgcggctgtgtctgcggcttttgatagcttctcatttcctgtgctgcaagctctgcaagcaccgggagagagtcactttttttctccggacgaaactctttttttgtatcggacaggctgcccgtattgtctaattctctcagttttgcatatattttatcacgttctatttgatattcacgaatgacttttacctctgcttcgttcaattgttctaaacgtaagcgcagcgcttctctttcattaaacatgtgtaaaaccccctgtcaaaaatttaaacgcttttattaagatattagattacaaaagtaattttatcaactattattttatcattttactattttatttactctatgaaaaattgcttattttctgaaaatggtactttatatacaaaaatcccttatcatataggggattctggacaaagttccaatttattgaaccatttcaaaatataacttgaaattacttgtttaatgaaaattagcgtgatatctacaattttcgactataatatgtaaaagttaatgatatggataaaacaagcggtacagcgtgtttacggctgtttctcttattttttaagccatacatgccatattggaattttttatccaatagccacaaaaaaaccctgttacctaacggcaaagggtttgcagaaccgagacaatagtccggcggagattgtcccgattactcagaagcctgctccgtttctgaaagtacccggctgatgcgtttttcaagcattttcatcccgctctctcccgcttgaaaatggcggagctgtccgcttttatcaaaaacgtaataagccggcacatattcattttcaaatgcgtcagccagcgtatgatcgctgtcaacgtaaatcggctgagagatatcgtgttcagccgctgttttcttgattttctcaagatcaagatcgtcttcggaacggggcatgtggacggccaccacattcagctgatctttatatttatcacgaaacccgttcacctcaggcatcgcttctttacacatgcggcagctggcggaccagaagtgaatcagtgccggctttccgccgaccagctgttccttcgtaacttctctgttaatccatgctttagcgcctgttaattcaggcatttgctgatgtaatttcatcttatttccctccttatgaaaaaagttttttgccggggctttcagtccgcctggcaacgttctcctgttttccctccaaaggaaatgatttggctgaatcaccatgttaaaatgagtgtggcgattccttagttcatatcttcacaaaaatgaagatattgaaaccgggcaatatgaacaaatcataaatgtaataactggtttctatgaaaaggtttatcttatttaaaaaacgggtatatcacttttagctttttcctcaatagacttgaaaggaagacatcactatgattgatttaaaacactttgattgggccgggcttctcacatctgccgggattttcatcataaagctggctctcattattttagcgtattttattttccggacggcaggaaaaaagctgatcaagcatctgtttcagaaattcgagcaacaaaacaacctctccacaggccgcgcttatactttgcgaagcctcgcgcttaatgtgtatggatacatcctgattttcgtttttatcgtaatgattttggatttatttcactacaatccgagcgctctcattgccggcgccggcgtggtcggtctcgccgtcggcttcggggctcaggggcttgtcagtgacatcgtcaccggattttttatccttttggaaaaacagatcgacgtcggtgattatattacggttgccggctacagcggcattgtcgagcaggtcggtctccgtacgacgcaaatccgtagctttgacggcacgcttcactatctccccaaccggggcattacgaatgtgagcaaccattcccgcggaacgatgcaggcgcttgtcgatattaaagtgccgcttgaaaaaaatcttgatgaaaccattcaaatcctgcaaaccgcgtgtgacaaagcagccgctgagctcccgcagattaaggaagggccggacgtcatcggggttcaggatttaagcacgtcagaaatggtgatcagaatcattgccaaaacagaaaatatggagcaatggcgggttgaacgcgtactgcggagagaaatgaaaatcgcgctcgaccgttttaaaaacgccgcttccgccgaatagaaaaaccgaagcgtaagcttcggttttttctttttaatgaaattttttttccacttcgctgcagatttcgtcggcggtcattccggaagccgtaatgacgggagcctgagttgacgtatcggcaatgccttggacattgctgtcaagtccggttacgacacagcagtcacaattcttcgcatcctcaggagtcttcatcatcactacgtcatatcctttttgttttaacgcctgttctacatccgataaagattgttcaattccaatttttttcgtcatattgaacacctccgttatgtagaatgctcaatttttgttagattattcttcttttcggatttaattggcatacttcgaaaaatatccgaccatgacatttaccgcggtttccatcgcatcttcatccgggttcagcttggcgtgatgaagcccgtgggatgaatcggcccccagccagaacataaagccgggatattttttcagcatatatccgaaatcttctccggtcatcgcttctttcgccgttttcacgtcagcaagctgatgatcgctgacaaattgcataaattcttcggtcaggccgcttgtattataaacttgatgataaacggacggatacgtgacttttcctttgcatcggaagccgatttcaattcctttgacaagctcttcaatccgctttttcaccatacgcattgattcctcggaaagcgtccggatggttccctccagatgagcatgctctgcgatgatattttgcgccgtgcccccggtaatcgttccgacagttatcacagcgctgtcaagcggatccgtatttctggatatgaccgtttgcagctgcgtgacaagcgtgctcgcggcaacgaccatgtcatctgctgtatgcggatatgccgcatgtccgcctttcccctcaagatcgatgacgagctcgctcgtattggcaaacagcaatccgcttttggtggaaatggtgccgaccggcagctctggtgctatatgtagggcggtgattaaatccggcgtccattttttcagcacatcgctttcaagcatcggtgccgctccgcccggtccttcttcagccggctggaataaaaagagcagatcatgtttgacggggtgatggacaaaatgatcaataatgccgagcgcgatggtcatgtgcatatcgtgtccgcatgcgtgcataaaaccggggtgctcagatgcaaacggaagccccgtctgctcttcaatcgacagagcgtctatatccgctctgtaggcgagcattttttccggagccgtgcccttgattttgacaaagatgccggttctccaagtttcgatttcaattctttcttccggatattggtttaaaagattcagcaggtactgctgggttttatattcctgaaagccgatctccggaatgcggtgcagatctcttcggatggcaatgagccgctctttttccatatgtattcctccttgagataagaataaggcgtggattttatcatccacgcccattctatcaaaccattccttacagctggcgtaattcctgtttgatttctgttttgccttttgttttttcatcgatatctttgatttttttcgctggtgttcccgctacaacggtatatggctcgacgtcatttacaacaatggctccggcggcgacaaccgcgcctttaccgattgttacgccttcaagcacaaccgcatttgcgccgatcacaacgtcgtcttctacgacaacaggcttagcgctaggcggctcaataacgcccgctaatacagaacccgctccgatgtggcagtttttgccgacagtggcgcgtcctccgagaacaacgttcatatcaatcatcgtaccttcgccgatgactgaaccgatattaatagatgcacccatcatgataacggcattgtcgccgatctcgacttggtcgcggataatagcgcctggctcgattctcgctttcacatcttttaaatcaagcatcgggatcgcagagttgcggcggtcattctcaatgacgtaatcctcaattttgtctttgttttcttcgattgcgcttttaatttcagcccactcgccaaaaacgacgccggattggccattcaggaatgttttagcggaatcgccaaagctgattccttcgagatcgccttttacatacacttttacaggcgttgattttgtactattttgaataaatgaaataatttcatttgcatccatcattttcatatgtattgtcctcctctgattttctacctcattactgtaacaaaggaaggatacaaagacaagaaaaaaaggaacaagcctttattctgccggctggctgcacagcgcggcaaactgtcttccgaattcccggagctcttcttcctcactgccctcagggttgttttcaattttgaccggcggcagcaccacccgtccgccgcgggccgtgattactttttccaattcgtcaaccgctccgcaaaaaaactcataggacgtatctccggaaccgaacaaagcaaatgtttttcccgtaaactccagtttttccatatcttcagcaatatcgagcatttcatcaggaagatccccgtctccccacgtatatgtgcctaataaaatatactcgtaatcattaaaaagtccggcatgaatatccatcgcttcatatctgtctacggatgcttgtgcttcgatcagccctttttcaattaaatccgccatcgcctcggtgtttcctgacattgtagcgtaaacaagcaatacattccccatcttcgtctctcctttatgcataaaaactaatgtgcgagccgaaccgcctcatacggtctgacaaacttactttcgtaaaggcccgcgcaaaaaaaatcttcttcccggttggccacccgccatccgtgaccgcggatcgtatcaaaccactttaattcaccggcagcgagatcagcttgataaatacgcgaaaatccgctttcgtcctgtgacgaagtgacataaataatcccgttatcctcagacacgtcaagaaatgatttttcccgtacattgtccccggctgtaatggcaaactcctcatgcgtccgcacgtttcggacagcaagctccccccgttctccctttgccgcgccctttgctgcaatgagccagtcattctgatacatcatcattgaagccgtcatgcgctgcctttcgcggcttatacgccggatgcggccttccgtcgtcagatcatacgcccaaatgccgccatgattcatatgaatccgggtgccgatataaaccgtctgaccgtgtaaacaaagcgaacggatgacaggcggctcctttaattgtgaaaaaggcttagccacatgccaagtgacgccgaaatcatcagataagtagatgcagtatgtgccgtgcgcacagacaaatccgtcattccgcccggcaacggcccatacggaggcgctggtcggaaatcgggaggccgtccaagtctttccttgatcggccgatctgaggacggcgcctttttctccagccgcgaatatgtagggccctatataagtcagcacatgaatcctgctcttcactcggaatagtcttttccagccttcttccgccgaaaaatgaaaaataccttcgcctttcacagcgacaaaaaatcctgaagatactgatgccatgacagccgtcgcgcctttatgaaacatggcaccggtctccgtggtgagcggcccatgcaagaaaaccgcggacaaattctttgcagcattcttgatcttcagccgtctcgggcgccagctcaattttcagcgtttccggatataaattggctccggcctgttcaaacgcatcgcaaaacagcgtgaccgcttcgcaaaacttcgggtaggcgtgatcgcctgaaccgaaacaggccgttttcagtccgttgagctggctgtgcagaatatcttcgtaaaaatcttccgcttcgtaaggaagatcaccatccccccatgtgtatgtgccgacaaaaacataatcatatgctttgagagaatccgcatctgcttcgtccatatcaagacagtcaaccgctatctgatgcccgctcagtgtttcttttataatgccggcaatatcctctgtattccccgacatgcttgcgtatatcattaatgctttctgcatatgatcacctcgtaattgataatgattttcattaacatacataacactttaaatgataatgattttcattgtcaataaaaaataaaaaaaagacagcatgattgctgtctttctaaaatgggcgttcctgtttcagcatatctttaatgacagaaacaaaagcctgcacctgttttaattcaaatgccggctcataaccgagcagccatgtgtcacggccgatcggatggtcctttgtatcaagcaggggcattttatttactttatcttcctcttctaaggtgactgacggcagaatggcataaccgatcccgtgcagcgccatttgcttgcacgtttcaatctgatcgacaaggatggtctgtttcggcgaggttttgaatttttgatgccaccaatgctgaatttcctgaaaatatgtactgtcacttttgaattgaataaacggccggtcggtatgggcaatatcatcaatacaggaaatttccgtatcgaccaaatataaatgatcggtcattaaataatctttccggcctttccattccggatttccccggataatgccgatatgtacctgatcttcatacagacttttcagcatttcgctgctccagcctgtaatgagagagacctttgcattcggatatcgttccacatatgtttttaacactttcggaagccagtgctgcccgataatggaggcgacggcaagctttaatgtgccgtgaatctcaccctcaagttcatcaatgttttctctgattctttcttgccgatccgtgacgtcatttgcaaattgtatgattttttctcctgccggcgttaccgtaagtcctttttgagacctaagaaagatctttgttccccaggttttttcaatggtctgcaatcgctgggacagagccggctgtgacacgaataaccgttcggcagccttcctcatgtttaattcctcagctaaaactacgagcatatgaagctcttgaagctgcatgtcgtcctccttttcaatgccttttcgtattccttatctaccattctaatcaaataaaggctgccgaggcaagcgccactcgtatgtatgcgttttctttttctggcatgcgaaagaacaaataggctgatcgtgcgagcctacttattcaatgatctgatatgactgctcaactgctttaatacgactcttctcgtgaaaatgccttcaaagacgccttcatcattttcaacgcagacaaagccgttgttaatgaccatgctgaaccctttgataatcggatcattgatgtggagacggggaatgtctttcagcatgacttcctcaaccgtaatttgatccagcttctcaaactcgatccgttcaagtccgaaaatgctgttcataatcatatttgtcccgatcaaaccgtgcagacggtacgaagcgtcaaggacgggaatggcggtatagccggttttcgtcagcactaatagagcatgctcaaggttgtttccgacttgaacgtgcgccactttatccgcctcgatcataaattgtccgactgttgcatcaagaagctgatctgattgtaagctaatcatgtcacttcgacccctttacatttttcatcaaagcatgtattccctatattgcaataatataaacattatcattttttgtcgaaaagtttccgtcaataaaaaagatactctttgcaatcgagtatcaatttataggccgctgattaattttcgttccgaaaacggtcatagagcgttacgagttttttataagtggtcccatcaacgctttttgaccctgcttctatatcgttgatttcgctggtcaaaagctcaatggcatattcttgattgatcaggatattcagcagaagtttctgttcttcttccgtaaatcgttcactgataagactcatacgtaatcaggccccctatttttaactgaatacctctgaaagcaatgtgaaatttgctttcagctctaccgctagaataagtaaacagaaaaaaatcgtcaaccgcataattcgacattttgcggattctgtatgaaatattattttgtgtaacgattggcataactgaatgctgtgcaggaatcgggcttgattttcgcttcaatacccatcgaggtaatgcggccggtcatttcttgtatcaattcttttgtcagccctttttgaccgatatccagatgcacttcaaatgaaagatccgccccttcatccgcaaaaggcaagagcaaatctgtcagttccataagacagccgtcgaggatatgcgcagccatctcctggctgaacgcggtttccagcgagattttttcgcgaaggctatgtatcggtcttgcaaggtcgtgatttttcaaacagccccaagctcccttgcctgtacggtgcaagtgtatagccgtaataaactttgtgaagtcgcggtaaacttgtgaatcagtccctacagacagcacgtatgctgaacgggggtctttattgacaaagcgtttcagccgctccgtcacgtcttgaaaggtcatctgtgcctcagaaagattataaaacagaaaagaatcagccatgtacggacactcctctttccagagtctacaaccaaacgaacaagcacgttcctttgcataatttaataaagctccgcttgcggaagaccggaagcttggtcagcctgaaaaatcaaatcacattactgaaggagctcaaaaatttcaatagaaatcatgtcaatgttatcaaacggatatgtgttaggtttttcacctttttggaaaaccgtcagttcaaacgtttgatttttttcgaaatatttaacactgcaaattttttcgccgttaacttcaaaataacgctgcatcggctcgttagccgcttccgctgtttcttgcagactttgcagccgcgtgatgatacccattaattgtgacattctaaaaaaagactcctttcaaaaaacaacttcaaatcaacaagtatttattataatacaagtcctacagagcatcataccataaagtagaccgggatggcattttcccgctggattttcaaaaagaaataaacgggaaaaccgtgttttcgaatagtttgaagcttttttcggaatgtcatacacctttcaaaaataatttttcgctttttgagccgccattgtcagatgtatgtaaggagaagcccttttatgcgcagacagcataaaaaaacttggcgggggtagcgccaagctttttcggatcttgatctgatagaggggttggggaacagagagtaacttctctctataactaaatgataatgattatcactatcattgtcaatcgttttttaaaactttttcacatttataaaaaaaagcggcatactgcagccgctttaaagtaacccgtcctgttcatataaataagagtaaggcagatcgataaataaatacatattgtcatccatcgggtatgaaaaggttctgatcatctcacccgtctcaatatcactgtacaggtcactgaaaaagccttttcttgaattccgcatcttcataatgttttctaaaaagtacggacgccagctccagtttttctccacgtattcaggctgataaagccattcgccggactgcttgaacacatttcccgtcagctgatagccttcttcatcacacatataaattctgaaacagcagtcggtcaggttttccgccagttttttaataaactcatcgtccgcctgatgggttttcttcagttcggaaactgcctgattgacccgcttataaaaattctcagagtgttcgtatactgtctccagcttctttttttctctcgtgataaattgctgaaactccgttttcaagcgtgcttttaacaggctccggtctataaaatcgccgctcggcgcctgcagataataaccttgaaaaaatcggcctccgtttctccatgcgtactggagctgaaaatcagcttctatatcttcatacagcagcgcggcgccgatttttctcgccagcaatgaaatgctgtacagcacatgctcatacgaaggtgacggctgagatactttcagcgcctgcaaatctattttcagaaggtccggtgaaaggagcgcgattctgtccaggttgctgctctccttacctatattgtccaccgcgattttaatgccgtatgtacgatagtaggcaagcatatggtacagctgttcaatgtcgccttcgaaattgtgctcggtgatctcaagcacaatacggttcaattcaatgccctgctcttcgtattctttcaaaagctcaagaaagctctcgccgtggtcaagcatcaatacattcgcatcctgattgataaaaatcaacagatcgcgatcagcttctttaaaccgctccagcgcctgcctgatgactctgtcatcgacctcaagcttatattcttccgggatgccggaatctaagaaaaacggcccgaggctctcaatctccgcatctgccaaaatacggccaagcacttcgtagcctacgactctttgttcctcagcgttaaaaatcgcttggtaatacggaataacatcatcaatattcgtcagtatatcaagtgggtccaacatgttatcacctgcttctctatctttgtctgattatacacaattatatcagcaccacaaatgtttagattaggggaaaaaggaggcagtatggcagcagtttaaaataaaaggggaaaactttttaagatcactcttcagaccggttaattaaggacgttattcatttgtttcaccatcacaaataaaaggataaatataagagcatgataaccggcggctgtccaaaaataatggctccaatcagtactgttaaatatccaatcatcatcatgtttcaactgaaagaaagttccttttttatctaaagtgccaaatgtaagagttgttaacccgccagcactcttggaaacgtcaacttcatacattgaaccggcatgatcagtatgatttattggcatatacgtataatcagataaaattgtttccgccagcttggttggcagagacacatatcatacagccgatgtatcgcctccgagcccactcaaatactccctggctttaataaatttcgtttcatcaggaaaatctatatgatatagcttttcaaatctgattatttcatcagatgtaagattggtattttgataatactccggagtaaaagcgcaaatgataaagtaccaaatattaaagatgataacgaaactgcttacaaatagtacaacgaaccattttaataatttcttcacttattcacctcttaatctttaaaaattatatcataattttgaatagaaaaataaaacaagcgaacggtcacctttaacgttcgcttgttttgcaaaatatgtcatgtaaattaaaacgggtaaggattcagccattgccccccgtccattgtgatacaatccccgtttatataggatgcttcatcggatagcaaaaacgctgccaaagcggcgatttcctccggtgtccccagacggccgagcggcacactgttcatagtgcgggacaccgctttttccgattcaaacagcttctccgcaccgcctgtccgttcaatcgggccgggggctatcgcgtttgtgcggatgccgtatttgctcccccattcaacggccagcgttcttgtcagtgacaatacccccgctttggctgcagcggaatgaacgacacccgctcccgctccccatgcgtatgtagcggccatatttaagatgacgcccttctgctcctgctcgatccaatgccttgccgcggcttggctgcagaaaaatgtgccgtttaaaacaatctcaataacagctttccatccattgggcgtcagcttctctgccgggcaaataaaattgccggccgcattgttaatcagcgcatcgagccggccaaagacttttttcgcttctgtaatcatgtctgaagcggcggaatcagaacggacatccatttgaaaacaggcgacctgcccctcaaaggtctcaatttctttttttgtttcctcaagtgcttcatggttcctccctgtcaccatgacgtgccatcctaattcagcctgttttttcgccattgcttttcccatgccgcttgaaccgcctgtaatgattaccgctttcttatccataacaaacccaccccttttattgaatgaataatcattcataattttatcatagatgtctttccgcgtcattacatgctgagaagggatttttcagccaggctgatgatataatagaacaactctgacaaaggttggttttacatatggagaaaatgacgagaagaacatttttaaaaagaggattcggcattttgggtgcaactctcgcaacggcttgcggaggttacggctatgcccggtatattgaaccgcgcatgattgagatcacccgtcatacaatcaccagccgcctgatcccccgcggctttgacaattttaaaatcgttcaattcagcgatacgcatctcagtgatgtgtttacatccggtgacttgaataaagcagcggaaaagatcaatcagctgaaacccgatctgctcatctttacgggagatttaattgataagccgcatttatttaatgatcaccagcaagcactggccgtgctgcaaaatctggaagctcccttcggcaaactttgtgtttacggaaaccatgaccacggaggctacggtacgaacacgtacaaggctctgatggaagcggctgattttcaagtgcttcgaaatggctgccgtcaggtgcagctgacagacggaagccggattgaactcgcgtttttggatgatgtaatgctcggaaaacccgattatgaaggcaccctttcccgcctttccgaagatgcgttttccattttaatcgtccacgagcctgatgccgctctcaagatcggcggatatcccgtaaacctccagctgtcgggacacactcacggcggccaggtccagctcccgtttttcggccctctcattacgcctccatacggaaaaacgtataccgacggcatgtatacgctgcatgacacagccgtttacgtcaatcgcgggctcggtacgacaagactgccgtatcgatttttagccagaccggaaatcacgctgttcacattgaaaaccgtacaaaaataagacttttatcccgatgcacagacatcccctccgtaatatgtatatggaaaagagcaaaaaggagggtgacgaaactgctgacatatcaagtgaaacaaggagaaaccatctcaagcattgcgcaagacttcagaataagcactgctgctctccttcaggcaaatccctcaatccaatcggtcatatacgcgggacagcacattatcataccgaatcttcccgacccatccaccattccctattccattgtcgtgtatatcggagcgaagaaactggagttataccgcctcggcaggctcatccgtacgtaccccatcgcagtcggaaaaatattgacgaccacgccgaccggagaattttacattgtgaaccgccagcccaagcccggcggcccgttcggcgcttattggctcagcctctctaaaattcattacggcattcacggaacaaataacccttcctccatcggcaaagcggtatcaaaaggatgcatccggatgtataatcaggacgtcactgaacttgccgctaccgttcctaatggaacaagggtgaccattataagatagaaagatcttatttgttaatggaacgagctgatgataatatattacagtgggacctttagggtaaggagcgtgtttatggatatatttaaaaatcgcaattttgtccgtctctttttcgcagcactcgcttctcaaatgggaacgactgtaggtaatatggctttcgctttttacttgctggaccatttttcaaaccagccggcatacacaactttggctgagctgatgtattcactgccgacagttttcgtatttctgattgtcggtgtcgcagctgaccggcttgacaggaaaaaggtcgcagagaattgtgattggatcagagccggactgacgatcgtattatttgccgcattatacaccgggagcatccctctcgtgttctgtattttgttcatcagaagcgccgtgaccaagttctttttcccggcggaagccagccttgtacaagctattctgcctaaggagcattatgcgaaagcggcgggacttaaccagatcctgttcagcatctttatggtattcggcgtcggtatgggcgcgtttatgtataaaacgatcggtattcacggagccattatccttgattttgtcagctttattgtatcaggctttctgatccgcgcctgccgcattccgaaagaagcccgtcagccgaacggcccttttaaatggggagattcgtttctgaaagactcggtcgctgattttaaggaagggatcgtatatattgttaaaaacaaattgcttgcttcccttattttcggcttttttatctttggttttgtcaacggcggctttgccgtactgccgatgtttacgatgaaatacggacttgcgcctgatcattacgaatcacatacttccatcttcaccgtcgcactcggcttcggcctgcttgcaggaagtgtgatcggaacaatgatcgcaaaaaaagtcaaaccgcatcatttgatgtcgattcctattttggcagccggactgctcatttttgtcctcggctatacggataagctgtggatttattatgcggcggctttcatcctcggcatgtgcatcggccctgtcaatatcgccatcggcggctggatgccgaaaatcgttcatccgaaaataatgggccgggtcagcggctggcaggatccttttatgatgtttgcccaatcgattacactcggactggttgccctgttatttccgaaattcgtttccaatattgattacctttattacggcatgggaatcgtgattttagcggtatttgtgttctattttatcgctcttccgaaatacagcgccgaggcagcagaggtcgatgtgcagcaatcattaaaggctgattccgaaaaacatgcgaaacctgtctaataaaggaaaaaaatgcgcccttttcatcagaaaaaggcgtatttttataatcaatatttgcatttcaacgctaaaaaagtataatctatatatgaacttgatcaatgcaaaggagagaaataatggacgaccacgcttattcgaaagagctgcagccaaccatcgagaatctttcaaaagctgtttatactgtgaaccgccatgcaaaaaccgcccccaaccctaaatacctttatctgctgaaaaaacgggcattacaaaagcttgtgaaagaaggcaaagggaaaaaaatagggcttcacttttcaaataatcccaggtttagccaacagcagtcagacgtacttatctctatcggagactactattttcacatgcctccaacaaaagaagacttccagcatcttccgcatttaggtacgttaaatcaatcgtaccgcaatcctaaagcacaaatgtctttgacaaaagcgaaaaacgtattgcaaaaatatgtgggcttaaaggaaaaaccgcttgccgccaacaggcagcagcccgcttatcataaacccgtatttaaaaaacttggtgagagttatttttaattccgccgcaaaaaagccgatgcgtcatgcatcggcttttttctattcaatcacgtacgtatccacttttttaatgagctcgctgatttcaggcttgctgatctgttcatccgctccgactacttcgccccggtggcgcaggtcgtccgtaatgagggacgagaaaatcataatcggcacatcagagctttgcgggttatccttaaggagcttcgtcaaacgatgcccgtccattttcggcatctcaatgtcactgataatcatgtcaatatgatctgacaggtttgctccgttatccgtcagttccacgacgtaatcatacgcttcttttccgttttcaaatgtaacgatttcactgtaccccgcctcagtcagctcatccgtcaaaagacgcatcagaagcggcgaatcttcaacgatgatcagttttttacccgcccgtctttcatcaaatccttcctgatggacatgataagtctcaactccggatgccgattcaatatcgtaaatgatcttttcataatcaggcagaaagatcatcgtgtcttccagtttgatgattcccgttaaatgccgctccatgccctggttcagggaagtcggcttttcaatcgcctcccaggacaccctgtggatttgtgaaacggaaccgacgtgaaagacgattttccgcttgttgaattccgttacgatatatttatcgtcttttgctccttcggcatcaacgccgaaaaaggaatacagactgatgacgggaagaatttcgcctctcagcttaatcatcccttctacgtctttatgagactgaggcacagatgtgacatctaccggctgaatgatttcccggactttcatcacatttatgccaaatgtattgacgcctacttcaaatttgacgatttctaattcgtttgtgcctgaatccaataaaatatcgtattgttgtaaagacaattcaatccctcgctatccgcattcagtattgtactgtatatatcggctgtaaacggaaaaagtgaatgtattcgggccaactggccatgaactctttataaaaagatgcttttttctgatatcccattgactttttgacatcgagtggtaaaatagtcaaggatttttcaggaagaagggtgtaataaatgggtacagtagtcatattcgaccaagatcaaatgacggtgttagaagatatcagcaaaacggcttacctgcaaatgaaaaaagaggcgaaagagcgtcccgacaagcccgctccatacatcttatggcgggaagacgtcagctttgaatacgggtattaatgacattcgccacatatcacaatagatagatcatgatacaatgaagacaatcatttcagctggttgtcttatttttttctgaaaaaaggtatgttttcacatatcggacatatactcgggatagttcaataaaaagatgacaaatgctcagctagtggtaaaataggataaactcaatatatagtataaggtgatgaattatggaacatttgcttaatccgaatgtaaaagaaattgaaatttcaggaattcgcaaattctcaaatcttgtagctcagcacgataatgtcatttcgcttacgatcggccagccggatttcttcacgccgcaccatgtcaaagcggctgccaaaaaggcaatcgacgagaacgcaacggcatatactccgaacgcgggcggccttgagctgagacaggccgtacagctttatatgaagaaaaaagctgatttgaattatgaggctgaaactgaaatcattgtcacaaccggagcgagccaagcgattgacgcgtctttgcggacgattttatctccaggcgatgaagttattctccccggaccgatatatccgggctacgaaccgatcatccgcatgtcgggcgccgttccggttcatgtggatacgacgacacacggatttaagctgacggcgcggcttattgaagaatcgctgacaccaaaaacaaaatgcgtcattcttccttatccgtcaaatccgaccggtgtgacattgtctgaggaagagctgcaaaacatcgcagccgtcctgaagggcagaaatgtttttgtcctgtctgatgagatttacagcgaattaacctatgacagaccgcattattcgatcgcgtcttatttgagagaccagacgatcgtcatcaacggcctgtcaaaatcacacagcatgacgggctggagaatcggtttcattttcgcaccgaaagaaattgccaagcacatcttaaaagttcaccaatacagtgtgacatgcgcgtcttcaatctctcagaaagcggctcttgaagcggtgacaaacggtgttgatgatgcgcttattatgagagaacagtataaaaagcggcttgactatgtatatgaccgtcttgtttcaatggggcttgacgtcgtaaagccgtcaggcgcattttatatcttcccttccattaagtcattcggaatgtcatcgtttgattttagtatggctcttttagaggatgcaggtgtggctcttgtgcccggcagctcgttttcaaagttgggtgaagggtatgtgaggctgtcattcgcatattcactggatacattgagagaaggcttggaccggctggaagcatttattttaaaaacgagagaatccatgcagactatttaaacaacggcataacgccgttgttttttttattgtttcgggaatgtaatgtgaaaggccgtgcctctgtccggtttgctgtctacttggatggctccctggtggtttttaataaggttgaatgtgaccatcagccccaggccggttcctttttctttcgttgtcaaaaacggttcgcctattcgtttcagcacgttttccggtatcccgtcgccctcgtctttcaccgtcacattaacggaatactcatcttctgtcatgatgatgtgaaccgttcccccatccggcatcgactcaacggcatttttaatcagattgataaacacctgtttcagctgattttgatcaccgttaatatacatgctgtcatgttcgtaatccgttttgataaaaatccctttaagattcgcctgcgtctctaaaagagcggtcacttcacttataattttctttaagtttacacgctctttcacggcgttttgctgaggtttggcaagcattaaaagctcacttaaaattaattcgattctgctcagttcggaaaacacaatttcaaagtaatgttcgttttcctccatcgtcggcttcatgagctgtaaaaatcctttgatcgccgtcagcggattgcggatttcgtgagcgatccccgccgccagctgccctgcgatagacagcttttccgacttcagcattaattcctccgtctgcttccgctcagaaatgtcacgcagaatgacctgcacggccgtttctccgaaaaacgtcgtcggaatgcagaccatttccgtgtagatcagccggtttttaaaggtaaaccacgattgcttaatgatttctgactcggtctttcggttgataatattttggatccgctgtttcacgccgtcatgatcacagggatgaagctgatcatagacgtttttcccgattaaatcttcatatgtttcagcctcaaacagcgaaatgcccgattcattcatgaatacccacttatcattgtgaatcacggcgatcgtgtcaattgaattctgaatgaggagctgataacgctctctgcttttttgcagaatcgtttggaattttttccgtgaagaaatatcaatcagaagcagcaattccgcccgctgatttttatatgtcgtcggtgccgccttcacttctaaatgaacgggcgtgccgtcgagccttctccacgtctgttcgatcattccgacttccattcctttttgcatccgcacaattcggtttttcacaatgtcgtgatactcttcttcaataaactcataggagcgcctgccgattacctcgtctttgctttcggctcccagcatggcaagcatcgcgttgttggcgtaggcgattgtgccgttgatgctgacatataaaggattcggcagcatttcaacaagacgctcgaattcgccgtttccagccgcatcttccgactgttgttctgccttttgcttcttttgttcatacatataaggccggcggggcgtcttctcctcaagcaccttgattttgaggatgatttcccgatccgtcccctccatttgcggtgtgacaatttccacacccgcttcaagccatacgatggtatgatcttttttaataagacgaaaggtgcaaggcatcaaatgatgctcattatagaagtaactttcaaccaaaaattgatcttcttcatgcaggaacgttttgagaaatgacccgatcatctcttcctgagaataactgaagtacgatttacagtttgcggaaatatacataatacgcccgttagacgtcaaaacggcatgaagatcggttttcgattgaaactgtttgacatgctgagtatcctgttccacagaatccctcctttgcattatactcgcactgcaggctggacacggactgatataaaaagaaattccactagattgattcgctaaaaaatgagcattctccttctattcttattgtgaacgtcaattttcctgaatgaaagaaagggcgcacgagatgttcggccgccctttcatttgttattttttattgtatttcttttcaagttctttgtaagcgtcaattgctcccttagcaatgtttttgcttacatgatctttatcatttccaacagacggaacgacgacgctgaatgccactcttggatgctctgacggataatagccgacaaaggtcaggttatacgtgtacttcccccaccagtttttgttcgtgccgtaatagtgcgtctccgcggttcccgtttttccggaaacatcagcgccggaaccttggaatgttgaataagccgttccttgaggtgagcttgtgaccaatttcattcctttatgaacttggtcaaaatcgctcggactgttatttactttgttcaaaattttaatatcccgctgttcaatcgcttttccaatcttatttttgctgtccggttcatgaatgcttgtgacgatccgcggctggacgcgatacccgccgtttgcgatggctgaaatatattgagccatttgaagcggcgtatacgtatcaaactgtccgatcgcaaagtcaagcagcaatcccccgaccatttgcggatttgactgcatgcccgctgattcctgcggaagatcaatcccggtcttcacacccaaaccgaattgggcgtagtagttgcgcatttttttaatatcgtctaatccggcaggcagcgtgccgtacggcctgtaggtaatgccggcgatatgcatggccacatgaaacatatacacgtttgaacttctttgcagcgcggtcagctcagtaatggctcccatttgtgtccacgattgttttctcgttttgcctttaaatacaagcggtgcatcgacaaacgttttataatgcgggaggccgctttggtaacccgcgagaacagtcgctcctttaacagaagagcccatctcatattgggtcgtaaatgctccgatcgcaaaatcctgtgttttatttgtttcgagatcgatgcgtttccccgccattgagagaatatccccgttgttcgggtccatcatgacggcaaatcctctgtcaaccatatagttgcctgcggcgcggcttcttctcagctctttttcaatgactttttcgactttcgactgtaattccatatcgagcgagagttgcagatcgtagcctctgctgccttcatcgacgggcttttggctgacgacctcacctttgctgttttccacatactctactttttctttatgcgcgtttaaatagtcctcatactgatattcgatgtagctttttcccacccggtcattcagtgagtagcctcttgtgacatagtaatctttccgttcgcccaacaatccctgttccggtgtcgtcacaccgccgaacagagagtacagcgttttgtcgtatggatattttcgcgtccagtcattgatcacgtcaatgccggggagctctttcaggtgctcggatacgacggaaacttcttcatatgtcagatcgctttttggtttttgcttgttgttttcatgctcgtcaagcaatgaaccgctgtttccgtttccgttcagcttattcgggtccattgatttgacgacttgcggctgataggcgttgccgcttgaaaaacgcgtataaatcgccgcaatttgcagctcttttttatcttgtttgatcgcatcaatctcctgcttcggaacgcgttcaatctggcgtttgtacacttcttgggatttcaggctgttttctgaatccttcataagcttttccgccttcttcggatgtgccgcaagccagtaatcaatgatatttcgatccttcataaattcagtatcaatatgaatcagtgcggcgagattttttgccgttttcaatttgtcctttgccgaggtttttgaggtagaaacgtatacaatttcaggcacagcctggttatcaaccgccaccctgttccgcttgtcatacatttttccccgcggtgtcggataataggcggtttttgcatttgccttctccgcatcctggcggtgtttatccccttcgacaatctggacgatgccgagtttaaaaatcagtgccgtaaagagaagaaacacaatcaaaaaatagagattcattctcagcgctctgtaacgtttcgtttttttctttggttcgcgcgcgacttcagccactttctgttacacctctcaaatcattgaatatatttacataaacagattttaattgtaacatttttgtaaaagttgttacagcgaaaacgggtaaaaaaaactgtcaagatcaaattatcttaaaatatatctaacacttcaaataatttgaagagatgtaacggattttaaaaaataaatacagatcgtttttactgatataaagccatttttctgtgctcaattacaattatgacaaacgtttgttgtcaaaggaaatggctgcctgcattatgacaaaaaagctgtgataagatttttcatgtagaaaaaaacaacttctctgggaggctataaacttatgaaaaaagcatttctcttatctgccgccgcggcagtcagtttgattacattcggaggcattcagcaggcatctgcaaaagagctgtcatgccagcacgtcgttactgtgaaaaaaggaaacaccgtacagcatctgactcttcaagaggctgttgaaaaactacatatgaaaacgagcgtgaaaaagctgaacgttaaaaatgagaaagaactgactcagctgctgcaaaaacacgcaaagcattctgatatgacagttaaagacgttcaaaaagaaacaccggaaaaaacggccccgacagctgccgaaaaaccgaaagccgatcaaaaccagacggctgacaatgcaaagcagacagataatacaaacaacagcagcgagaaaactccttcatcagtcagtgcgtatgaaaagaaagtcgttgaattgacaaatgcagagagacaaaagcaaggcttaaaacctctgcagattgatgaaaaattaagcaaatcagctcacgcaaaatcacaagatatgaaagacaaaaactatttcgatcaccaaagtccgacttacggctcacctttcgatatgatgaagtctttcggaatcacttataaaactgccggtgaaaatatcgccaaagggcagacgactcctgaagccgtcgttaaagcttggatgaacagtgaaggccacagaaagaacatcatgaatcctgagttcactcaaatcggtgtgggttatgtagaatcaggaaacatctggacacagcaattcatcggaaaataaataaaaaaagattgcccggcgggcaatcttttttttatttcacccaaagcttataaatgctttgagttccgctgttttcttcaccttgcgcggaaagcttgtcgtacaatgatttggccagcgccaatccgggcatttcttctcccatgagctccgcttcttcaagggcaatgcccatgtctttaataaagtgtttcacgtaaaatccgggcgcaaaatcgcctttcagcatacggggagcgaggtttgacaatgaccagctgccagccgctccggttgtaatgcttttcagcacttgttccgggttcagaccggatttttccgcgtaagccatcgcttcagccactccgaccatccccgctgcaatcgcgatctgattgcacattttcgtatgctggccgctgccagccggcccttgatactgaatattttcccccataacggagaaaagcggcaggcatgcttcaaacgcttctttttctcctccggccataatggcaagcgttccgttcctcgcgccgatgtctccgccggaaacgggtgcatccagggcgtgaatggacttttctttggctttctccgctattttcttcgccagagatggttttgatgtcgtcatatcaatgacaaacgccccttcttttgcatgacggagaatgccgctttcaccgagatagatttcctcgacatcactcggatagccgaccatggtaataatgatgtctgctttttccgaaaggtctttgaccgtctcctgccagaccgctcccttattcagaacctcttccgctttgtgtttcgtacgcgtgtagactaaaacaggatagcccgcttctaaaatgtgcgatgccatactgtttcccatgacgcccaaaccgataaatcctaccgttttgttcactgcgctttcctcccctgatgcgattcatatatcactctttcatgtctatattaccatattataggctgatagagaccgcgtcacaaggtgaatttagaaatggcgctgatcagatcttcgcttgcgctctttaacatatcagtcgattgcttcactttttcaagcgtaacgagctgttcatcagtagaagcattcacttcttccgccgctgccgcagattcttgagaaatggcggagatgctttgaatcgcttcttgaatcgaggcttgttcttcactcattttttgaatgtcattgtaaatatgatctataccttgaacgagagactgcatttccgttgtaatcagattgagaacctcacccgtttcatgaatggcgctgttttgttcatcattcattctgcttgcctcaatcatcgcgtgtgacgcttcttttgtctcagattgaatcagacggaccgtctcactgatatggccggaagaaagagctgattgttcagcaagcttgcggacttcttccgcgacgacggcaaagccccgtccgctttctcccgctcttgcggcttctatgctcgcattcagcgccaagagattcgtctggtctgaaatagcggatattgccgtcacgacttcttctatgtttttcgtttgttcttccaggtcattcagcattgcctctacttttttcgtttctgaattggcttcgtttgacttcatcagcagctgcccgagcgcgtccaatcctttgtagctggcatcctctgaagattttgagagttgttttatgctgcctgcgcgatctgcgattccttttattttgactgagagattttctgatttttcgttgatcgtctcaacctctgacgcttgctctgtcgctccggcggcgacttcctctatcgcttttgcgatttgtccgctcgtttcatttgtttcttgtgaaatgacggttagctggtcagatgtatcagacacattttctgaggaggccttgacctgttcgaccatctctttcatattttcaaccatttggttaaagtcttttgttaactcgcctacttcatcttttgatttcgtctgggcgcggacggttaaatctcccgctgagactgaatttgtttttgcgatcagctgctgaatcggcccggttatcgtttttgcgaggaaatagctgagtccgatcgtaatcacaagggcgatcagtgacataaaaatgctcaccgtgttcattttgtcggctactcccatcagctgatctttttcaaactgcgttccgactttccaccctgtttcttttaccgtttggtagacgaccatgttcccctgcagctctttgatgccttctttgtccgcagtgatgtcttttaacgtctgatcttccgaaatattttttccctgttttgccggatgggccagaagagagccgttttcatccgccaaaaacgcaaatcctttatacggaaccttttgctcgttgaccatgctctgaatggaggacagcttcaaatctaagctcgccactccgacgacggttccgctgttttgaatggcttttgacgccgtcacgatcatgtctcccgtcactgcatctttataagggtcagtccagacaaccttatcgggtttttcagccgccatcttataccacgttcgatttgtcagatcatagtctttggcaaaatcggcctttggatatgtaaacatttgtttgtttgcggttccgacgtacgcaagcgcgacatatttgtcattctgtccgatctgttttaactcatcgttaaaaagccgcgcggtttctttcttcccatctgatagaaaagaccgggacaattcaccgtctgctaatctcattaatacggtctcatcatttttcagctgaagctcaatgttctgaccgagtgaattggtgacattctctgtcgtacgttttgcttcctccgtcatcatcggctttaatgtcaaatatgaagaaaccgttaaaaaaacaaccgttacaataagcattgccgatacaaacacagcaattttgatatgcatttttttaaacataaccatcccctcctgagagttatatcggtctttcggccaagaaaatgaataaatcttgaaataaatatcaaacatttccgtcatttgtcgcagcaaaaaaaagagccgtcatgccgacagctccgccttacgtaaaatattcgattttcgctttcggaaaataggtttcgatataagattcgagtgtttcccttaaggcatgttcttcgtctttttggtatatatatttgccgattccgtagcgtccccatttgtacctgcgcttttcttcatcaagctcaagctttgttttcggatagttcttctcaatcacccgtttggccggttttgtaaaacgatgctggatcagttcaaatgtgatgtcatgccgaacgtcttcatcaagcgccgcatccagtttctcaaacagctccttatagccttcctcccagccatcatgaatataaataggcgccacgatgaaaccgagcggatagcccgctttagcgactttgacggcggcttcgatccgtttgtcgagcggagaagttcccggttcaaagttttttatgacataatccgcattgatgctgaatctgaacctagtctttccgttatgttttgcatcaagcaaatgatcgacgtggtgaaatttagtcacgaatctgagctgccccaattcgctttgtccgaaatgttcaatggctctttttaatgtatgtgtcagatgatcgattccgacgatatcagacgtacaagaggcttcaaatcttgtaaattccggcgctcgttctttcatatactcatcagcctgatccagaatctcttctacattgacatatgtccggatgtaaggctttgaccccatcgtcgtctgcaggtagcaatagtggcaatgccccatacagcctgtcgcaaatggaatggcatattcggcggacggctttgaagaatcgaatttcagtgttttccggacgccgattaccaatgttgatttcgcgttccggtattgctgcaagtgatttttccccggaatattccggacttgattatgcgatgttgtttctctgatctcaagccccatattttcaaacttattcttcagctcttgtcctaacgggtattcgagcgctctcggttctatataaacaagctggggcacaaacggcttcagcatgaactgacactcccttttttcatattctcatgttgttactttccgtttaaaagagagtgaatatgcgttgtaaacatttcctttgatcaatgatatcggtcttcttcaaaaagctcgctgtaaagcgcttccgcttcctcatatgttgaaaagaccgcgtcatcttcggccagcggatgataggtttcgtataaaaacagagacagttctccctcatgatatgggtgatggacgatctccgcctctttaatatgggcaacattggcggcatgcggattgcggtaaatcacatagaccgtatcccccgctgcaaatgattttgtcataataatccctcctgttgaacgttattgttccccccttttttccgaatatgaaaaaaaccagacggcttataccgtctggctgttgtattacttattgaatgtttctttaacgaatgcgacaacctcttctgtcgtgctcatagacaagattgtttctttgaatgattcagcttcttttttagaaagcttgctgatctgcgttcttgccggaaggatggatgtagcgctcattgagaactcatctaagcctaagccgagaagaatcggaatcgcaatttcgtctcccgccatttctccgcacattccgacccatttgccctctttgtgagcggcttcaataacaagggtgatcagacggagaatcgccgggttgtatggctgatacagataagctacgcgctcgttcatgcggtcagcagccatcgtgtattggatcaagtcatttgttccgatactgaagaagtcaacttctgtagcaaactgatctgcgataacggctgtagacggaatctctaccatcataccgacttcaatatcgtcagaaaccgctacgccggcttcgacgagtttttctttttcttcgagaagaatcgctttcgcctgtttaaactcgtttactgtcgcaatcatcgggaacatgatttttaagtttccgtatgtacttgcacgaagcagcgcacgaagctgagttctgaagatttcttgctcttcaaggcaaaggcggatggctctgtagcctaagaacgggttcatttctttagggagctgcaggtaaggaagctctttgtcgccgccgatatccaatgtccgcacgacaactgattttccttccatacgctcaagaaccgttttataagcgtcaaactgctcgtcttccgtcggaagctggtcgcgtcccatgtaaaggaattccgtacggtaaagccctacagcttctcctccgttttcaagaacgccttttacatcgtcaggtgtgccgatgtttgcggcaagctctacatgatggccgtcttttgaaacagtcggttcattgacgagcttcgcccactcagctttttgcgccaggtaagcactgtgcttttcttcatatttctttaacgtttcactggaaggatcgatgatcacatcaccatcgatgccgtctacgattaccgtaacaccgttttcaattgtccctgtagccgcttttgtgccgacaacagccggaatttcaagcgaacgggccatgatcgcggagtgtgaagtgcgtccgccgatatcagttgtaaaaccttttacaaactggcggtttaattgcgccgtatcagacggtgtcaaatcttcagccacgataacaacctcttctgagatcatgctcgggttcggaatttccacgcccagcaggtgccccgtcacacgttttgttacgtcacggatatccgccgcacgctctttcatgtattcgttatccattgattcaaacatagtaacgaacatggaagctgtttctttcaaagcgaattcagcattgactgaatctgtgctgattttctcctttaccgggttcagcagctcaggatcactcagaactaaaaggtgcgcggagaaaatgtcagctttgtcttgtcccagttcttttaaagcatgctctttaattttttcaagctcttctttagaacgtacaatcgcttcatcaaaacggcttacttcagccgcagcatcagcaatgtttttcttttcaaccgttaagtccggctcttcaagccggtatgctttcgcaatcgcaattccggctgaagcgcctattccttttaattcttgcattactcgccgagtccttcgcttttcattgtttcttctaaagcgttaagagcatcgttttcgtcagcgcctgaagcggaaattgtgatttcagcgcctttagcgatacctagagacataacgcccatgattgacttaaggtttactgttttgccgttatattctaagtttacgtcagcatcgtatttgcttgcagtctgtacaagaactgtcgcaggacgagcgtggattccggaatctgctgttactttaaatgttttttgtgccatgattatcattctcctttaaattaaagctattttactacacaatattatatcatacagccgtacttgtcatctgacaagcacggcgtatttatatgcttattttccgattttcacaatatctttttgttcccgttttacggtaccttcggccgaaagggaaatcgcttcaccctcggcaagatttgtaaagacaatcggtgtcattaatgaaggaacatgaggtttaaccgcttcaagatcaacttcaagcagcttttgccccggttcaacccggtcaccctctgaaacaaaagaagtgaatccttcgcctttcaggctgactgtgtcgattccgaaatgaatcaggatctctcttccgccgtcagactgaagaccgatcgcatgttttgtcgggaaaacattcagcacttttccgcggacaggcgatacgacgattccttcttcaggaagaatcgcaaaaccgtcacccatcatttttcctgagaacacctggtcaggcacatcggtaatcggatggatttcgccggtgatcggagaagcgaacacttcttcaccctgctcgtttcggagcggatctgcgataacctcctcaacctgctggctgacttcttcttgtgcggatactttcggttcagggcgcggcgtgcgtccggcgataatatcctgcatctgtgtttttaaaccgtcagaacgcgggccgaaaatggcctgaatgttgtttccgacttcaagaacgcctgaggcgccaagctgtttcaaacgagtcttatccactttcttctggtcgttgaccgtaacgcggagtctcgtgatacaagcgtcaaggtgcttaatgttttcctggtcacccattgcctgcaggatttcataaggaaggtcgccggcttcgcctgaggcgcccgcaccttcatccgcagcctcttcttcacggcccggcgttttcagattgaactttctgatcgcaaaccggaaaccgaagtagtaaataacggctaatcctaggccgaccggaatgacaagccaccaagcggtccggttaggcagaattccgaacaggaagtagtcaatcagaccgcctgagaacgtcataccgatttttacatgcagcagctgcataaccataaaggaaagtcccgcgaatacgcagtgaatcgcaaacaggataggagccacaaataagaatgagaattcaagcggctcggtaattcccgttaagaaacttgtcagagcggcagaacccatgattccggctacaagttttttcttttcaggcttcgcttcatgatagattgcaagcgctgccgccggaagaccgaacatcataaacggatatttccccgtcataaatgttcccgccgtcagctgtacgccgtctttgatctgagccatgaaaatccgctgatctccgcggatgatgtctccggccgcatctttatagctgaaaaattcataccagaacggcgagtagaaaatgtgatgaagaccgaacggaatcaatgaccgctcaatcatcccgaaaataaaggccgccaaggttggattcgcttccacaagacccgtggagaaggaattcagaccgtgctggatcggaggccagatcactaacataataagtccgagaattaatgcggaaattgatgtgataatcgggacgaaccgcttacccgcaaagaatccgaggtactgcggaagttcaattttataaaacttgttgaacaataacgcggccaggaccccgacgataataccgccgaacacgccagtcgccaaagtgggtatccccagcatgttaatataggccggatggttttccgcaaaaaactttgcccgttcaattttgtcagacggaatactgccgttcgccataagcacggcgctcatggatacgttcatgaccaggtatccgataatggccgcaattccggcaacaccgtctccgttggcaagaccgatcgcaacccctactgcaaaaagaagcggcaggttgtcaaatacgatttggccggcgctttccatgacgttcgccacaagctgaacgttatcattgcttaagaaatgcatgacttgaatcatatctttgttctgcatggcattccctaacgcaagcaagatccccgcagccggtaaaatcgcaaccggaagcataagagcacggccgattttctggagaacgccgaataatgctttaaacataaaagatgtacctcctctgttagctagtgtgaccttacagcgaaaattcatgacaacgaattcactggcgcaagtcttcagtttaaccgtttacatttgcccttttacacaacaaaaaaggcatgagtaaaaagggtgtgcaaaataacgggatcgttcttcccgttttttaccctcaatcactcatgcctgatcgaatcagtgacacgtttttaaggtttcaactgaaattatgaaattttattggttaatcggtacaaatgaagcgtgagataaaccgcttccgcctcatgaactggttttttcagtatttgctgcaagatttttatcagtttccaagcagtattgtagcatagcgggtattcatttttcaataataacattaacttttctggttcttttgtctgctcttcccgattaatcctgtctatggtaaatctgatatgccggatcagccgcaaatagtggacgctttctttattcactttcatctggaaagagtcctcaatcacctgaacaaggcgggacatcagctgcgaatgctgattgacctctgaaaggggccgattcgtcagggcggaatggatatgcagagcgataaagccgatctctccttcaggaaggcagattcccgtcttttcattaatcatgccgacgacttcacgggcaatttggaattcttccggataaagcgtttcggtttccatgagaaacgggtttttaatgtcaaacccctgctgcagccgctttaccgcaaaggcgatatggtcagtcagcgcaatatggatatgctcatttaacggttggcttgtccgcttcttgatatgataaatgacgtcattggagatgtcgacaagtgtctcgtccacataaccgaggagctttttaaattgtttttgttctttttcatcctttaagatgaacatcttgtcataccctttatcttcaatgacatccgcttgtttttttccaaagccgatcccttttccgattaagacgacctcactgtatctatcatgtgttgcgatgagcacattgttatttaataccttttcaactgtaaaggaccccttcatgatcctcagctcctttgtcattcaatacctcatatcgtacaaaacgaacggaaagcgcgtcaattctttttttagacggttgatcgttcaataaggcggtaatcaagaactttccttcccggaggcccgccgctgatccggttctcaagcatgtgaaaagcctgctttcccatttctttcgtttgtatatctattgtggaaatacctaacatcttgctgatatcatgattgtcgatgctcaaaatcgcaagctcttccgggatgcgcgtcccgtttgccttggcttcaaggtaaagacctgcggatacttgatcattcgccgcaaacagcgcagtcggtttgtcatcccagctcttccatctatgaaaaagggctttcccgtcaagcagcgtcagcaccttttccacaaccagctcttccctgtaaggctgcccgatcttcttcagcgcctctttgtatgcggcgattcggacttgactgttttttcccttttttctggccaggcagatcgctattttccggtgtcccttttctatcagataatccagaccgtgccgaaatgcttcccgatgtggattactgatggaggaaagccctgccgcatcagtgtactggcagaggatgagcggttctttcacggcaagcaaatgctcatcaggaattgctttggagcagataatcaggccgtccacttggcgctcctgtaattgtgataaggcaaaacgttctttttgctgctcataatctgtctggtataaacaaagatgcacgcctgacgcttcggcagcctcggcaatacctgcaacaaggtctgcaaaatacggaaggttcaccgacggaagcacaacgccgatcatatcggaaaaacctttggataaatgaacagcatgaatgttgcgcgtgtatccgagcgattgcatcgcttttttcactctttctcttttgtccttacttacataaggatgatcgtttaaaactcttgataccgttgtaacggaaaccccggcagcgccggcaatgtctctgatcgtagccatggcgtcccccctttctttttttcccttgatctggaatgcgtttcatacagtaagctagaaacagatacatcctatccgtttgaaaggagaagaacagcgatggggattctttgcttaatcggtttgtgtctggccatactcggcggcagttaccttgccctgcggcccctgaatgaaaagcatgacatcaaaccatttcagcattttgatgattttttcatttaaaaggtgataaaaaaggacgctgcgttccagaaccgtccttttttatcacaaagctttctatttcagaatcgttaattctttcggatactgcgttaatgcttcggcgccgtcttttgtgacaaacacatcgtcttctatgcgcacgccgccgacatccggcacgtaaattcccggttctatcgtgtacaccatgccttctttgaggagtgtgtcgttcgcgctgctcattgatggatattcgtgaaccgaaatcccgagtccgtggccgaggcggtgcgggaaatagtctccgtatccggctttttcaataatgccgcgggcttttaaatcaagatcgccgattctgacgccgggtttacttaattgaagcgccgtctgttcagctttaagcaccgtttcgtaaatctcttcctgtttcgggctgattgattggtatgcgaatgttctcgtaatgtctgaacagtagccgtcaagaataacgcccagatcaaacagaacaaaatccccttttttcaaccggtctgcacccggattcccatggggctggcctgatttttccccgaacagcaccatcgttgaaaatgacatgccctgcacaccttttttcttcagctcaaactcaatctgcgcgagtacttcggtttcactcacaccctctttaagcgccgcgacaccgacttcaactccgtaatccgcgagttttgccgcttccctgagaatgctgatttccttctcatcttttacgagacggaattggttgagcgtttcttctgccgaaacaaatgccgcgcccccagaagcttgtttgagctgttctgagcgggaaagagagatcgaatccttttcaaccgcgatggaatcaagcggcacatttcgttttgtgagctcggctttgatcagctcccacggatcttcgtgatcgccgtagccgataataccatgctcccaaccggcgcttcgggcttgtccgtcttccattcccggacaaacgaaaaacggctcctgttcctgaaacaggaacaatcccattaaccgctcatgcggatccgtgtaaaaatcagttaaataaaatacgttttcctttgtatgtataaacgccgcatcatgtccttcttttttcagccaagatgaaacacgttctaatctgttcattttttgattttcctccttaccaaagtgactctttattcattctatcagttttccggcgtttatgctgtgaacgaacattaaaaaaacagccgcccgatgtgcggctgtcatgtttattttaataatctcagtccgttcagtataaccagaatcgtgctcccctcatggccgattacgccaaacggcagttccatcacctgcagaaagttagcgcagatcaaaaggcagatgaccgagagcgagaaaacaatattctgcttaataatccggttcattttccttgaaagtctgcacattttcacaagcttgtgaagatcatttttcataaggactaagtcagccgtttctagagccacgtccgtgcccccgcccatcgcaataccgacgtcagcggttttcagagcgggcgcgtcattaatgccgtctccgaccatggcgattgtgccgtacgtttctttcagcttcttcacttcttttgccttttggtccggcagacaatcggcaacaaccgtcgtcatgcccgcctctttcgcgatggcagccgcagtttcagactgatcgccggtgagcatggctgtttgaatgcccagtgattcaagctcagccatcacggctttggcttcaggccggatttgatcctttaaggcgaagcagcccgcaatccggtcttctttcttaacaaaaaccagtgtaaagcctttatcctttaattcttttcccgatgtctgcaaaaaagcatctgccgcatgttcacctgcaaatcccgcttttccgaccatccatttgacgccttctatttcagcctgaacaccgaatccggacgtctcgtcaatcgatagatggcctgcgggcgcggcgccccggctttcggcaaattcagctatcgcttttgcaagcgggtggcttgattgcttttctatcgcatataccgcctgcatgatctcatcttcactcacattttccgctgcttgaaatgccgcgactgccggctgtccctttgtgaccgtgccggttttgtcaaatgcgatcatccgtacgcttcccagctgctctaaaaacacacttcctttaaccaataatccgttgcgggccccatttgagataagggaaagcgcagcgggcataatagaagcaacaagcgcgcacggggaggcgaccaccataaacaccatcgcccggtaaaaggtttcactccagctccagcctaaagcgaaatgaggaacgaataaaagcacagccacggctaacagcacgcctttgacatagacactttcgaatcgctcaataaatgcctgagccggtgacacgctgttttgggctgattccaccagccggatgatttttctgaataaagactgttcatttgttttcgtcacacggaccgttaaggagccgtttccgtttaccgttcctgtaaacacagaatctcctgctgttttttccgccggcatcgcttcacccgtcagcgccgattcatcgaggctcgtcacgccagactcaataatcccgtctgccgctacgcgttcgcccggcttaatgacgatcatgtcaccgatcttaagttcagcagccggcacccgcttttcccgtccgtccgcaagcagggtcgcttcctccggttccagtttcatcaaggatgttaaatcacggctgcttttattcatcgtatatgtttcgagcgcgccgcttaacgaaaaaataaagataagaactgcgccttccgcccaataaccgatcagggcggagccgacagccgcaaatatcatcagcagttccacatttaacgccttcgtctcaatggtatcctcaattccctcttttgcttttgcaaatcccccgatcaggaaggcaaggatatacaaagtgacggacaggccttttgtttcggtaaaaaaccaggccgcaagaataaggacgccggatacgagcgccgcaatgagttctgcatgctggagccacctttttccggcccgctcttcttgtatcttctgctgttgtgaatgggtttgtgtcatcacttgttcattcattatgaattctcctctctaattgagaacgcaaatcatcttcaattccctgataaaagtaaaacagccgcctgacaggcagcattttcacagtgttatcgcagtgttttctttattatagcatgccggcggaagatttcaattataattgttttaatttctttatgataataattatcattagtgtttcttcagctgttcattatatgcaaaaaaggtgcgggaggaattcctcccgcacctttttatttctctgaccattcttttaattgtgaggcggtcatcggaccgacgatctttttttcgatttctcctttttcattcagcagaaatgacgtgggaatcgtcatgacatcgtattccttcataagctcgcctttcgtgtcaagaacaatcgggaatgtgagatggtgctgagtgacaaagttttgaacggtatttttatttcgctcggcattcatcaaatttaccgttacaaggcttacatcatcagactgatgctgttcaaaataggtttggaattgcggcagttcttttttgcacggcggacaccacgatgtccaaaaatgcaaaatcgttttctgccctttattcggaatcgatatttcgtctccttcaatcgtcttcatcagaaacacggcgggaactgcctgtttttctgatgaggcttttgcttcaggcatccaaacggcggcagctatcaaaaggactgcacatacaattagacggtttttatgcatatgatcttcctttcacgcgtttcggatagcttgcccttccttattgaaatgtatcagccttttcagctttcgatccggggagctgttcttccgccgcccgtcaaaaacacggagacaccgaggtctttgcagatcgtcacgtaatgtaaacttgtcagaagaatcatgccggtattcataccgagtataatgccgagcatttgcaattccggcatagaaccgagcacatacatcattgaaagacctacaatgctgctccatacgttatgataaaacgccgttttcacgtggccgatgccgatcagacaggcttgaagcggcatcacaaacagatgaaaaagaaaaaacggccacaaaagctgcaaataatactgcgcttccggagactgaaaaaacaaatgggtcagcgggcccgcgaactgaaacatgacccagaccgccggaatgccgtagccgaatgtaataaaaatcgcttgtctcagccgtttcagcacaatatcatattgggacagcgcatacgcttctgaaatgctgggaatcataacgaccatcagcgaatgggcgataaatgcgggaaacgaaccgattgtcatcgctacaccggcaagcattccgtattgatcaatcgcggcggtcccggctgccccggacgccagcagcgctcctttaaccaagaagggttcaattgcgtttgtcaccgcatgaaatatacgaagtcccgttgtcgggatggatacggccaggaggcgtttccgcacgtctttcccgcgaagatgaatgtgctgatggccggaaagcgccctccgcgccaaaataaactgcgtatacagataaacgaacaccacaacatcgcttgcgaccagcacaaataacgaaataagcacggccatatcaatttcaaaagagtaccattgaaaaaagataaacagacaaagcacttgaatgatttttttcaagacattcgcaaccgcgatttttcccatttgctgcacacccataaaataacctctggcgatggatgtaaaagcgacgactggaatcagcccgatgacaatccctttaataaacgggtgatacgtatcgaatacaggaatgaacggcagcgcgatgcttgcggccgcggttgaaaacgcggtaaaaacggcggtcattctgaaggcatgccgaagcatgctttcatgcagcttctgattggattccgcgatgaattttgaaatagagatcggaagctccagactggcgatcacgataattaaaaaaatggtgggcagaatgctcatgtaaagccccatcccatgctcgccaagctcccgcgccagtatcatattcacgacaaattccagacattccgcgaaaaaggcggcgatggataaaagaatgatccctttcacaaatcgattcatggtgtctctccttgtctcacgttcttccatcatcatatgagacaagttctgaaaatattttcgatttctcaaaattgaaaaaagcatagcggggatattttttatcccgctatgcttcttacatcgcaaatacgtgtctgccgatccgttcgataatttttcgggaacggatccagtggtcagatgccgttttcggattgtagaaaaacaacgcgttcgtttctctgcccggatggtctagcgcctcatttgcggcggcgatggaatccttatccggcttttgattaatgcttccgtttgctaccggttcaaatgcattcctttgatagatcacgccccgaatggtatccgggaaaccgtttttttcagtacggttcagcactacgctggctaccgcaaccttccctttataagattcacctttcgcttctgcgtgaacgagacgtgacaggagctgtctgtcagcgcgggaatacgtttttttcggcggctgataagccgtctcgtccggttttgctttcttctcttggtgagatgacagctttatcggttggatagagtgcttatgatccgtttctgagagcttcggaaccgggctttttttatttaaatcagcaaccagtgtgctgggttcttgctttggcttcttcgcaaaagtaaacagagcttctgtatgttcaatttttgatgcaggcataaaacatagaaaaaagacagccaaggcagcaaattttgtcgtcatacgatttcctccttaaatacttcactaccttaacaagagctgtacgcaaattcacggttaaagattttccaatgctcccaatcagcttttatgatggaagaagtttgttaacagccttgttattggcaggaaaacagccgtcattttcacaacattaaccaaatagcagtaaaagtatccatcggagggattttacattttgtttacatctgttacagccagatgaaataagcagcgaaaacaaaaaaagactcctcaagtgcgaggagccgtcagcttcttggctgttctaaatactggaagataacatctccgccctgctgggcaataccgcggaaatgcttaaaatcttcctgcttcgacaaaaccgctcgaaatgcaagaaaatgttctttctgcaccctgaattctttgatttcaccgatgcgcatttggttgatacgttctgaaatttcctcaggcagcaacgaatacagcctccttttctcggctttttcccgaaaaacaatataccatctttcccccgccgggacaatgattgagcgggctgatacccatatcgctttacttcttaaagaaaatactgcaaaatattttcaaacaggatttatgataaaggagaggaagctcgtgaaaattgctaaggttggaaacgtcattgaatttaaaaacggattaaccggtattgttgaaaaagtaaatgaaaactccgtcatcgttgatgtaaccatcatggataattatcgtgaccttgaattagattccctcactgtcgtcaaccataagaattataaaatcatcagagactcctattaaaccccccgaacaatccgaaccatttacatatcccgcacaaaagctgccgcccggcagctttttcaaatgaattcagatctcggtcatttccacaaaaaaatcatcggtctcatctttattgtaaagatttgtgacggatgtatagtagttggttattttaccgcggaattcaagcccacgctcgggcgccttgatgtcaaatgttttttcatacaaaaggacggcaatatcatgatacgtttcagaggtcaccttcaatacgaatgaaatcatacggccgtttttacccgcactttctttacaatcatacattttcagccttacaccgtttaactctaacggctccataacgaacactccttctttttacaggacatgctaccatgctggccattcctttacaattgatccgctccgaataagaaaaaacagcgcagtcctttacaaacatacgttccctattttataatgaaacagacgagctgccatccagcacccgtcacgtattgaagcggcgagtacactccccccgggtttactcgtctttttcttttctccaaatgatctctcttttccttatagaagttctgtgcaaatatcatgcacctttttggctgcgtggcagagacgaaaaatacccccgcttaaaaggcgggggtatttaggttatagtccgagtccgtactccgtctgaaattaacgattatcaatcgtctccggatacatatcatgattcatcatccgatgttcggccattttttcgtattttgttcccggtctgccgtagtttgtatacgggtcaatggagattccgcctcttggcgtgaatttgccccatacttcaatgtagcgggggtccattaattcgatcaagtcattcatgatgatgttcatgcagtcctcgtggaaatctccgtggttgcggaagctgaaaagatacagctttaacgatttgctttccaccattttttcatccggaatatagctgatgtagatggttgcaaaatccggctgtcccgttttcgggcaaagcgacgtaaattccgggcagttgaatttaacgaaataatcacggttcacgtgtttattcggaaatgattccaaaacctccggcgcatattcaaataaatagtttgtcccttgattccccaggagcgtaactccttctaattctgattcttttcttgtcatataaatctccctttctattaaactccccgtttattgccccaaagcagcgtatgcagctgaggcaggactctgacgagattcagatccgaatcggctgaaaccttatcaacgagtgtttcgtattttccgagcagatgtgcgatcaatgcccggtcgtccgtcgtatggacgttatcgtttccgacctgaagataaaacgggatattcggataccgcttgtgcacggttttcgcgaattgcagatcttcatcattaaaaatgacgacctttaagctgaccgcgttaagcctttctgccgcatcaagcgaagacataatatgatcgagctttgcaaaatcggttgtcatccccgaacttggcggcttcggtgaaatcgtcaggtcgttaatcattgtgaaccaatcctgatagactgttccctgcgtttctaaagcggcgcgcaccccgtgctctttcagcagcagaatcagcgcgtcaagctgctttaacagcgccgggtttcctcctgagatggtgacatgagaaaaggcgtctccgccgatttctctcagctcgcggtaaatgtcttccgccgtcatccagcggatatcttttttggctgatccgtcccatgtaaaagcggagtcgcaccagctgcaggagtagtcacagcccgccgtgcggacgaacatggttttctggccgataaccatgccctccccttgtatcgtcggtccgaaaatttctaataccggaattcctttagccattcctatcaccttttttcgggcggtatacgcaatagcttgtcggggtttccctgacaaaaacctgcacgcagaccggctgattctccagtgtttcgaggtaggactgcaccttatcataaatcgttttggctacgacctcggtcgtcggcagtgaatatctgtcatcatcagaaaattcctcatggtcattcagcaatgtatggtcataagcgccgtgcaccaatttcttcagcacgctgaaattcacgagaaagcctgaatcgtccagttcatcccccgcaactgtaatatttactgtatacgtgtgcccgtggactctgctgcacgctccggcgctttcgcggggaataaagtgcgcggctgaaatgtgcatgtccttattcaactcaaacgaataaggatgctgaacctgcgggtaaatttgagaaagcaattagttccgctctcctttcattttcatatattcatcatatcctttattgcggagcaggcatgccgggcattcgccgcatccgtccgcaatgatgccgttatagcaagtcagtgtgttattctttacaaaatcaagcgcgccgagctcatccgcaagtttccacgtttctgctttgttcagccacataaggggcgtatgaatgacgaacggcttttccatcgccaagttgacggtgacgttgcaggatttgacaaactcgtcacggcagtccgggtagccgctgaaatcagtctcgcaaacaccggtaataatgtggcgcgcgccgatttgatatgcaagaatcgatgcaaaggataaaaatacaaggttgcgtcccggtacaaaggttgtcggcaattccccgtccttcgcttcaatttcgatatcatctcttgtcagcgcattcggcgcaagctgatttaaaagagacatatcaagcaagtggtttttgacaccgagcttttcggcaatcgattttgccacatcgatttcttcttggtgacgctgattataatggaatgtaacggtttccacttcttcaaagttttgcaaagcccataataaacaagtcgtgctgtcttggcctccgctgaacaccacaaccgctttttcttttttcatgtctttctctcccttatctatcattccataaaaaaagcgcctttttcggagaaggcgccctaaaaaacataaaaaaaccgtatccaaggatacagctcgtccttagttttttatagagggtgtagctagaacctctcccgcatcaatacggattttcttcttttttcacttttgctatcataccataatgttgtttcccgtgacaataaaaaaacagcctgaaccctgtgtcaggctgcaaaagcgggtttaagccccgcgtttcttccccggaaatgccatcagcgcaatcccgatcagaacaaataaagcaggccagaaaacagaaaccggaatgatcggctgatacgtcatcataaagcaaagtgctgtcaaggtcagcactgcaaccggaatgagcagcgccttctgtttcccgccgaacagccacagctcaaataaaccgaatgccgttgccaacaggtaaacaggccatgtcacatcggagtagaaccaattggttgccgtttcaaagacaaacaagatccccgtgatcaataagatgccgcccggtacgagaagccccgcgtttttgacaggtttcgggccgaaaatcggaatgtgaaaagcggcgcccagcaacagaatgagagcgggccagccgcgttcgctgatgacttcatttgcattggtgaatatgccgaaaatgcccgcggcgcacagaaccgccgcagcagtcaaaagccctctttgccttctgccgaacagccaggcttcaaacagcccgaatgcaacggcaaagaggtaaacaggcgatgtcatcgttgcgtatgtccaatccgtcagcgtttcaaaccataacaagccgcccgtcacaagcaaaatgccgcccggaataagaaggcccgatctttttttcggttgcataaaggcagcggcgtgaaacaaaagcgcggctgcgatgatcaaaagcggccacagccccgtcatcagcataccggcaaagcatagtgctcccgcggctgtcaggataaaagcaggaatcaatacgccgatctttctcccgccgaaataccacagctcaaacagaccgagagcaggcgcccatatataaacaggccacgtcatgcctgaatacgtccatcccgttgcggtctcaaaacaaaacaggcagcccagcacaagaaacataccgccgggaacgagcagtcccgcctgttcaggcgtttttttcgcaaaaataaatccggcgtgaaaccctgcggacattataatgaaaagaaacggccacgccgaacctgcggatatatgtataactcccgccttctgtaaaaaaaacgtaatgccgatacaaataaaaataaatcccaataatacacgtcgatccttcatctcttactcctccccatcatttcccaattcattatacagaaatggcaggaaaaaagaagggaattcccaaaatatacagacattttccttatttttctttcgggatttttttgcaaatcaatgcgcccataaaagcgaggctcacatacccaaacaccggataaacggtggaaatcagctgtccgtaaccgatttggctgataatgaaagcaaacgccaaaatgccgccgtaaatatatgtactttttatatgaagaaaactgtttaattgtttttccaatccgtataaattgccgataaccgacgtaaacacttccccgaaaataataaacaaataaatgatatgaagcgaacgcgaatacgaatagacaacttgagccatcggaatgtcaaactccagcacatccggcagcaccgataatgataaaaagctcgcggcaagcaccagtgtcaacagaacgccgcctatataagctccccttctgatcaccttctctgaagacatttcgttcgcaagcggcacaaggacggcttgggcgagcgataaatttaacgcgccgtaagagacggcggacaaaagccagttccacttgtcaggccatacccattcgtccgcgtttctcgtgcttgtaaatacaaatgaatcagctgtcacgataaaagagaaagaaattaaaagcggcaccaccaatatattgacgccgaacacacctttaacaccgcttgtcatgacggcaaaactcagtacgatcgtcagtaggatccccgcttgtgcgggccagccaagctgttcatgaaacagcgctccggctccggacagcatgacagaggtcactcccagcaatataaacatcataaacatgttcacggcgcggccgatggactggccgaataaatatgtgttcaattcctgataagatgctgcatgaatccgtttggaaataatcatgattttggcgcctaaatatgtaaacatcagaccgcttaccacgataccgaacagaccgatccagccaaacttcagaaaaaactcaacgatttcccgtcccgtggcaaaaccggctcctacaaccgtgcctacgtatacaaatgcaagctgacttgcagaaccttttgtttgtcccatttcaccctccggctaaacgcagatttgtccaggcctttatatatgcttatgagacaagtctcccgaaaagacgaacaaatcgtccttccccggaaaaaacagattcagctctctcctctaagcaaaaatattgaaagaaaaaaagggccggcgtatactcttcatcaagaaaggtcaaagcatttcatttcctttccgactatattggtcaaaaataatcaaacctcacgaatatcacttatcatgctgtaaacatttatttttcggggtttgaaacaaaatacttgaaagtcaaagaaggtcagagtatactaataatcaaagaaggtcaaagtttcgaccttattttctaacccatttggtcaaagatgatcaaatatttttcgaggaggttttggcaaatgcgttgtcaacattgtcagaaaaacgaggcgacgattcgcctgaacatgcaagtcaattccattcaaaaacaattcgttttatgtgaaacatgttatacagaattaacccgaaaaccgtctatgagcatggggccgcaatcattcggattcccgtttgagcaaggtttcgctcccaatcaaaataaacagcaggccggccctgaaaaaggcctgcttgacgagctcgctcaaaacgtcacaaacggcgcaaaagcaggtctgattgaccctgtgatcggccgcgataatgaagtggcgcgcgtaattgaaattttgaaccgccggaataaaaacaatccggtgctgatcggtgagccgggcgtcggtaaaacggctattgcagaaggcctcgcgcttaaaatcgctgaaggcgatgtgccgaacaagttgaaaaacaaagagctttacctgcttgacgtcgcttctctcgtcgccaatacagggatcagaggccagtttgaagaaagaatgaaacaattaatgaacgaattaaaagaacggaaaaatgtcatcttgttcattgatgagattcaccttcttgtaggtgccggctctgccgagggatcaatggatgccgggaacatcctgaaaccggcgcttgccagaggcgagctgcaggtcatcggggcgacaacgctgaaagagtaccgccagattgaaaaagatgcggcgcttgaaagacgcttccagcctgtcatggttcacgagcctacaatagaacaagccatcagcattctggaaggcattaaagataaatacgagaaataccacggcgtcacattcagcaatgaagcgataaacgcctgtgttacgctttcatcccgttacattcaggaccgccacctgccggataaagcgatcgacttattagatgaagccggctctaaggcgaacctggaacttgataccgtaaatgaagaagatgcggctgagagactcaatgcaattgacgcggagaaaacaaaagcgcttcaggaagaaaattatgagcttgccgcgaaactgcgtgatgaagaagcagctttggaaaagcagctggcgcatgaaacaccggcctcttcacctgaaatcggcgcggagcatattcaagccatcattgaacaaaaaacaggcattccggtcggaaaactccaggctgatgaacaagtcaaaatgaaggaacttgaagagcatcttcatcagcgtgtcatcggtcaggaaaaagccgtgaaaaaagtggcgaaagcagtcagacgaagccgcgccggtttaaaatccaaaaacagacctgtcggctccttcctctttgtcggaccgaccggagtcggaaaaaccgagttatcaaagacactcgcagatgaactgttcggtacaaaagattccattatccgtctcgatatgagtgaatacatggaaaaacacgccgtatcaaaaattatcggttcaccgccgggatatgtcggacacgatgaagccggtcaattaacggaaaaagtgcgccgcaatccgtacagcatcgtgctgctcgatgagattgaaaaagcccaccctgatgtccagcatatgtttctgcagattatggaggacggccgtctgacagacagccagggcagaacggtcagctttaaagataccgttttgattatgacaagcaacgctggaaccggcgaaaaacaggtgaaagtcggattccaatctgaagagagcgtcatggaagaacaaacgctgattgattcactgagcgcgttcttcaaaccggagtttttaaaccggtttgacagcattattgaattccaatccctgaaaaaagaacatctcgtgaaaatcgtcagcctgcttctcacagagcttgaagacacattaaaagagcgcggcatcagcctgagcgtcaccgatgatgcgaaggaaaaaatcgctgaaatcggctaccaccccgctttcggagcacgcccgctcagaagaaccatccaagaattgatcgaggacgaaatgacagatcttctattggatgacaacgaaatcaaagccttccatgtcgtaatggaagaggacggcatcaaagtccgggcacaataagaaaaaagcggttccctcctcgcggggagctgcttttttgtttctttctccatgccggaagggagaaactgtgaagaattcgggaacaatttttcaatcaccctaaagttccatgcactgccaccgatattaaccatagaaagctagtataaaggatttggtgaaaactatggataaaacatcgattatcggtatcatcctcgcagtgattgctttaagcgtgggcatggtgctgaaaggggtcagcttaagcgcactcgctaacccggcagctattctgattattttgttcggtacgatttctgcggtgatcatcgcattccccggaaaagaaatcaaaaaagtgcctgccctttttaaagtgctgtttaaagaaaacaaacagctgacaattgcgcaactaattcctatgttctctcaatgggcgcaaatcgccagacgtgaaggtctgctcgcattggaagcaagcattgaagacgtggatgacgcatttttaaaaaacggcctgagcatggcggttgacggacaaagcgcagaatttatcagagatattatgactgaagaagttgaagcgatggaagacagacaccaggccggcgcagccatctttacacaagccggcacatatgcgccgacactcggcgttttgggtgcggtcatcggccttatcgccgctctttccaacatgaacaataccgaggcgctcggacatgccatcagtgcggcgtttgtcgccacccttctcgggattttcacaggatatgtactatggcatcccttcgccaacaaactgaaacgcaaatcaaagcaggaagtcaaactgcgtgaaatcatgatcgaaggcgttctgtcagtgcttgaaggacaggccccgaaagtgatcgaacaaaaacttctcatgtatcttcctgcgaatgaacgcgcaaaagtcgctgaacaagaaggagaggcaaacaatggcgagaaaaaagaagaagaagcatgatgacgagcatgtggatgagtcttggctgatcccgtacgcggatttgctcacccttcttttggctctgttcattgtattgttcgccatgagctcggtcgatgcggcgaaattccaaatgctgtctaaatcatttaacgccgtgtttaccggaggcacgggtgttcttgaatattcaagcgtcacccctcctgaaaacgaaaaagacggcgttgatcagttaaaaaaagacaaggaaaaagataaagaacagaaaaagaaagaaagagaagcagccgaccgcgaagaacttgaaggcgtgcaaaagcaagtcaatcaatttataaaaaacaaaaagcttgaaactcagctggaaacaaagctgactaaagaaggactcttaattaccattaaagacagtatcttttttgattccggacgggcggacatccgtcaggaagatattccgcttgccaaggaaatctcgaatctccttgtgctgaatccgccgaggaatattatcatcagcggacatacggacaatgtgccgattaaaaactcacaatatcaatctaactggcatttaagcgtcatgcgggccgtcaacttcatggctattctcacggaaaacccgaaacttgacgcaaaagtattcagcgccaaaggtttcggagagtataaaccggccgtgtcgaacaaaaccgctgaagggcgcagcaaaaacaggcgcgtcgaggtattgatacagcctagaaacgccgcgactgaccaaaatcagtaatataaaaaaggaagcctttcaaacggcttccttttttatttctgatgaaaatgtttagcgtttaaccccactcttttcagcatttccgtacacatttctatctcttcatcactcagcacactgatcatttctttaatttcttcagcatgatcagggaaaatatcgtccaaaagacggattcccttttcggaaatttgtgcgaaagtcactcttctgtcagtcggcgaggcttttctgatgagaagttcttttttctctaatttgtcaacaacatatgtaatacttccgctcgctaataaaattttgtcgccgatctgctgaagcggctggttgcctttgtggtacagcagctcaagcaccgcaaattccgtcgggttcagaccgtgcttatgaatatgtttattcatatggtcgttaatagatcggtacgcacgtgacagtacaataaataatttcaatgagttttctgttttatccgtcatacattcaatcatccttttacaaaagaaaccgttacagagaaacattaataaacaaaatgaaaaatgtcaacaaaaatgtttccaaaatttctcttctttttgtctggccttaataaaataatttgtttttctatcattttggttattttttcttattaaagaagtataaaaatgatataatacctctattcaagtgtaatgttggagcgatgcagagtgaatacatttaaaggtgcccggggaaagatcaaactttatctcatattggtgatcatcccggcacttattatcagctttttcatttatgaaaaagaaaagcagaaaatagccgataaacacatacaggaagccagtatgatgctcaaccttcaccgcaataagctcaattatttaatcggtgaaacaaaagcccggatgacaacacttgcgatcgctgtcgataagcctgtcaatgaagaaaagatcattgatattctcgatcaggcttttgaggatgaacccagattcagcggtctgtatatgctgaattccaaaggtgatgtcatcgcaagcacgactgatctgaaatcaaaggtgaatttggccgaccgaccgtattttacgaaggcgaaaaagacgaaaaaaacggttatcacaaatgactactccagcagaattacaggccagcgcatcttcacgatctgcgtgccggtgttagacgcaaaacgggaagtcacggattatttagtagccgccattcaagtcgattatttgagaaatatgatcaatatgctgagccctgacgtttatgtcaaggcaaccaatcagaataaagtgatatttgccagcggacgggctgatcaatcagaaggggtgaaaccggtcagcggctatctggatgatattaattggaatatcaatgtttatccgaaaccggttgagctgaacgagctgaccaaaagcgtactgctgccgatgtccagtattgccgtgctgctgaatattctgttcatcctcgtccaatattatctgcttaagcgcaagacccagctggagcgcgctcaaaatgaagcgcagaaattggagctgatcggaacgcttgccgccagcaccgcccatgaaatccgcaacccgcttacagggatcagcggcttcattcagcttttgcagaaaaaatacaaatcggaggaagatcagctgtatttctcaattattgagcaggagattaaacggatcaatcagattgtcagtgagtttttagtgctcggtaaacccactgctgaacggttggaagtgaactcgctgcaggatattcttgatgagattatgccgattatttattctgaagggaatctgtataatgtggaagtgaatgtggagattctcgtcaatcggccgctcaaggtcaactgcacgaaagaccatattaaacaggtgattttaaatgtcgcaaaaaacgcgctggaatccatgcaggaaggcggccggctgtccatctatttagaagcccgcgaccataaagcagtcattaaggtggccgacaacggaatgggcatttctgaagatatgcttgaacacatttttcttccgtttgtaacgtcaaaggaaaaaggcaccggcctcggccttgtcgtatgtaaacgaatcatgctgatgtacggcggttcgattgacattcaaagcgaagtcgataagggcacagaggtcaccattacccttcctgccgcttcacgatgaaaaaaacaccctgggtcggggtgttttttatttaaagaagaatatgtgtaagaggatataccagaggaacggcatcatagccggcagatagtacgaggcgcttcgtgagccgtgccagcggaaaaatctgctgactgtacgcggtcatctttcggatgcggcgcttgatcaggaagcgcattcagtcttcgttatctgttttatcatcaatcatttgtttgcttcatatgcaggcatgacgtcaccgcgggagaacaagcctattttcttcacaaggccctgtattccttggtgatgtgtgcgatcacggtttaccagctgctgatacgcgttcatcagacagtccagttcctggctgtgcctgatcgtgtcatatccggtaaacccttgtctgttagccgcatctatcatcatttttctttttttatcaatagatacaagcaatttttcttgttcagaataactgcccattcacttcacccctcaccgctaaaagaataggaaacaagtttgattgggttattgagcattattacagattatactttatttgtaaacatttttttactaaataacttattttttcatttcatattggaatctttagcatgaatacgagaataatacccattcaggtaatgatataaacagaatgcggcatattcaagatttaaaaaacagccacagctgactttatattacaataaaaaacctctcataccggcgggggcatgagaggttcgggcgtctatcagttttgcacactttcattttcgtaaatcggcacccagccctcagtcgtcacgaaaattcggattgcgacgacccggcggtcttcctgaagcgtaaagtagtggcggatgttctccggaactgaaatcaaatcgcccggatttaaacggacgtcgaaaaatgtgccgtctttgccttgaatgacgaagatgccgtgtccgctgacgataaagcggacttcatcatccgtgtggtgatgttctctttggaaattttttaataattcatcaagattcggcgtggtatctgataaagaaatgacatcctgagactgatatccgcgccgggctgaaatgtcctgaatctccgtgtcaaacgccgcgagaatccgttctttttcatcttctgtcagattgtatttctccgaaagctcagacggaagtttttcaatgttccactgctcatagatcacctcttgttcgtctaaaaagcgcgctacttcttcctgattttcaatgagcgtattcttttcgtcatgtattctgatggtcgccattttccgttcctccttttattttacaagctgcggccgcagtgacagaagcttgaggtggcagctgaataaaaattcataggcttccagcacccttttcgcttcaaatgcggtccgcccccatgccgtaatgccgtgattacggattaacaccgcgcctgagccggcgtccgcatggtgcgcgaagttttcggccaatgccgggatgtgcgccgggttgtcaatgatcggaacggtcacggacgcgttttcctcccataatccgagcgccttaatcatctcctgcccctgaaacgtgatttgtttttcatccccgtaaagctctgagatgacattattattaacggtatggacatgcagacagcagccggcttctgtcttttggtataagtaagtatggagaagcgtttccgctgaaggttttaaagaatggccggtctcagcgggcttcccgttctcatcgattaagagaaaatcttcgtctgtttcttttcgtttgtcttttccgctcgccgtaacgaggaaagtcagcggcgcgtcggatactttgatggaaagattcccgctcgttgccgggaaccagtctctttcggccagctcgcgctttacctcggcaagttcgcgccagcgttcttcttttacagccacgcctgcacctccccgatgttttcaatgcctgttttcacctcatgaaaatcttgaaaaggcagatgccggaggccgagttctttgcattcagtcaaaagataatctctcgcaaaacacatatcggataactttgcagcctcaacatccgtgaccgaatcaccgatcataatgagaaatttctgctgatcggacagcttccggatgactgacggtttgcagcagccgcattgattggtgcagcctccgtcacaggcgtgcggccagtctatatgaatatattcattgtcaaaggatgcatgattgcagaaaatccgctccttttctacgatcccttccaaaagcggatgcacaaaaaagtccattcctccgcttacgatataaaacgggaggccgtttgaccggacaaacgagacaaaatccaaaaagccgtcccgtattttcgcatccttcagaataaagtctgtcagttcttcttttaagctgctcggcagcagtccgaacatccggccgactccttcttggattgataggcttttagacagaacaccgtcttttaattcaatccactcagggggcgcgaattctttcatcatgctgacaatgttgtcgttcatggtgaccgttccgtcgaaatcacaaataatcagcggtgtgcgggtcatacggcttccacccttccccatttgtctaatgcgagctgaagatctttgcacgacgcggctttttcttcaatcggctgcgcttcaagcaccgcatcaatgatggcgcggaacgctcttccgccgccctcggctcctttcggatggccgtgaatgcctccgccggcattgatgatgtgatcgatgccgaaatcgcgcatcaacaatggcaccataccgggatgaatgcctgccgacgggacggcaaacgacggatgaaagacatcgtcttttacacattcatcatggattgcaagcgcggactccttcggaagagcaacggatccgtaaggtgacggaaataaactgaaatcagcgccgcaatagcggttcagcttgccgagcaaaagcgcatgcgacaagccgtaaacgggagatgaagtgaacgcgccgctgactgccggatgcgccatgatcggaagcgggatttccctgtcttctgcaaggctctgcatcacatctaaaccgtaagcgaacacattcaataaaagcgcgtccgccccgagttctgccgcgcgcctcgctttatcccgcagttcagcggtccttcccgtaaggtttacggcatacagcgttttatgccccgtctcctcccgggtttccttcaggacttgttttccttcgataatgcgggtttcaaacggagccagttcattttcaaagaaaatttcgtcatctttaatcagatccacgcctccgagcgcctgctgtctgagctgttctttaatgtcggcgagattccgtccgatcacgcctttaaatatgctcatcagaagcggtctttcaaattcgcccagcagtttgcggatgccgtatataccgaatttcggcccgggaagggagcgtttaaacccttcggaaaattcaagatcagtcaattttatttttccgtccaatgacagctttccgaataccgtcgtcaggacggccggaatatctcttgaaaagttcgcctcgggataggcgatagtgatgacggattgtgtttcgttttctgaggttccttctttctcctcaacttttacgacccggcctttatgttttctgagctgttcctgcttcaccaggggcaggtcagtccaggagcctaccgtcagccccgccgcaatctgttccgcccgcttttcactgtccgttgtgtctgtcagaagatatgttgccaatacttcgctcatgcgtgaacgcctctctttctttcacaaaacataaaaaaacctcttccgtatgagcagaaagaggcttcgtgttatgtccgaatcttatctctcagctcctgctgcaagaattagcaccgtgctttatcagtcggttgccgggcttcatcgggctcgtccctctgcctgctcttgataagaataatgattttataaagtattttgaattatcgcattgttatccagatatgtcaatgctttttcgggtgaaaagattcagtttcccgatccgttccgcagcttctttaagtctttcttcacttgtcagaagaccgactcttatatagccttccccccattttccgaacccgtttccggcagcgacggcgacatccgctttctcgagcagcagatctgaaaacgactgtgacgtataaccgtcgggcacagggagccatgcaaaaaaggagccagccggagccgtcacatcccagccgataccgcggcaggcttcaatccatgcattgcgcctcgattcatatctgtcattttgcgctgcgacgcatgcctgatcctctaaaagagcggctgccgccgcctgctgcgccgcgggaaacaggctgacaaacatatgatcctgataaagattgatcgcttcgatgacagaagcgtttccgacggcaaatccgacccgccagcccgccatattatacgttttggacaaggtatagacttcgattcccgtctcctttgcgccttccgtctgcaaaaagctcagcggtttatgcccgtcaaagccgacggctccgtacgcgaaatcgtgaacgacacaaataccgttttgttccgcaaaaccgaccgtctcctcaaaaaacgcctctgtcgccacagcgccggtcggattattcggataattgagatacagcagcttcgcctcgctccgcaccttttcaggaattacgctgtaatcagggagaaaccctctttcttccgtcagcggcatcatttccattttcgctttcgcaagggcgacgcccgaccagtaatcaggatatccgggatcaggcaccagaatggtatctcccgggtttaaaagacattgcggaagctcaacaagtcccgccttgcctccgaacagcacggcgacttccgtgtccggatcaagcgtgaccccgtactccctttcataaaatgcagcggctgcttttttgaagctgtaagcgccccggaatgatgagtatttatgattttccggcctttcgacggcgcgcttcatttcttcaacgatatgctgaggcgtcggctgatcagggtttccctgccctaaattgatgacgtctctgccttctttcagcttttgatttactttttgcaccaatgatgcgaaaaattgttccggcagctgtttgagtacatctgagatttcaaagttcatatttttcaccttctaaaaatgtcttgaaatgatagtccatcatcatatatggttaaataaaaaaagtaaagagaaacttgaggtgttaaaaaatgaaatggaccgtttcctgtttgcaatttgatatttcatacggaaatccttcagaaaattttaaaaaagcggaatctttgattgagcaagaaagccgccatgcggatgtaatcgtgcttcctgagttgtggacgaccggctatgatctcacacggctagaccagctggcggatgaaaacggcaaagtttcggaacaatggcttaaagaaacggcaaaaacatacaacgtacacctcgttgccggatcttttgcggtcaaagaaggcgaaaatgtctataacaccatgtacatcgccgataacagcggacagatcgtgaagcggtatcagaaagcccatctgtttcagctgatggatgaacacctttacttgtcagcgggaaacagcgacggttcctttgagctcgacggtgtcaagtgcgccgggctgatctgctatgatatccgtttccccgaatggatcagaaagcatacgtcccagggcgcgaatgtcctgtttatctctgcggaatggcctctgccccgccttgatcattggcgaagcctgcttatcgccagagcaattgaaaaccaatgttttgtcgcagcctctaactgcacggggtccaatcccgataatgaatttgccggccacagcctgattattgacccgtggggccggattttagccgaaggagaccggacggaaggcgcagtccgggcggaaatcgatgtgtcagaaagcgcggccgtccgcggaaccattccggttttccaagacttgcggcgtgatttatattaattttcaaaaaaatgttgacaagaatatccggcacctgctaatattttcatcaactgattaatccgaattgtgatacaaatcaatatattttctcttatcgagagttgggcgagggaattggccttttgaccccaacagcaaccgaccgtaattccattgtgaaatggggcgcgtacattttgcgccgagacgattgtctcataaggcacggtgctaattccatcagatgttatctgagagataagaggcggactgcactgtttcagcctccttctctttcagagaaggaggctttttttcgggcgtattctccgtcacgatctcttactgccactacataattggagggtaaatccatgtcagcaactaaaacaagtctttatgaacaattaacagaaagctccgccgccgcgttagccgtcaagctcggcttattccaaagcaaaagcactctgacatgccgtgaaatcggcgacggcaatttaaattacgtctttcatgtttacgataaagaaaaccaaaaaggactgattatcaaacaggcgattccttacgcgaaagtcgtcggtgaaagctggccgcttacaattgatcgggcgagaatcgaaagcagcgccctcatccgccagggcgaacacgtgccgcacctcgttccggccgtttactattccgatactgaaatggccgtcacggtaatggaagacctctcacatttgcagatttcaagaaaagggctgctggaagggcagcattatccgaacttatcggttcatatcggtgaatttttagggaaaacgcttttttactcatccgattatgcgcttgatgcgaaagtaaagcagcagctcgcaaagcagtttacaaatcctgagctttgcaatattacagaaaggcttgtgtttacagaaccgtttctcgaccatgagaccaacgattttgaagaggagctgcgcccgtacgcagaaaaagtttggaacaattcccggctgaaagaaggcgctgacgaattgaaagccatctttctgaattccgcggaaacattggttcacggcgatctgcacacgggaagcatcttcgccgatgaacatgaaacaaaggtgattgatcccgagtttgctttcttcggaccgatcgggtttgacatcggccaatttatcgccaatctgctgttaaacgccctcagccgcgacggtgacgacagacagccgttatatgaccatactgccgccgtatgggatacatttgtgaaaacattcagtgaagcatgggagaaagactgcctgccttcccacagacacctgctggaagacacactgaaaaacgcgtttgaggaagcggtcggttttgcgggatgcgaattgatccggcgcacgatcggactcgcccatgtggctgacttagatgaaatcactccgtttgacaaacgaatcgaacggaagaagctggcgcttgagatcggcgcctattatatcgaaaacagaaaagaactgaagcatatcaccgaagttctggaccaatttaagctccgtgtaaaggaatgatgcagcatgaccaatgaatttgccatcccccgttccgtggaatggaaagaaacctacatccgcattttaaatcagcaaaaacttcccgacgtcactgagtatgtggaacttgaaacaaaggaagatgtattcgacgcgattgtcacgctgaaagtaaggggcgccccggccatcggtataaccgcggcattcggactcgcgctctccgccaagtcatttgaagcccgcgacctttcagatttccgacgtcagttcgcggatgtcaaagcgtatttaaacagttcgaggcccactgccgtcaacctcgcgtgggcgcttgacagactgacggattccatcagggatgcaatctcaatcaatgaagcgaaaacaacgctcgttcatgaagctattcaaattcagattgaggatgaagaaacctgccgaatgatcggccaaaatgcgctgcacctttttaaaaaaggcgaccagatcatgaccatctgcaatgcgggctcgattgctacaagccggtacggtacggcgcttgctcccttttacttagcgaaacaaaaagacctcggccttcatatctacgcatgtgaaacaagacccgttctccagggatcccggctgacggcgtgggagctgatgcagggcggaattgatgtcacactcattacggacagcatggccgcccatacaatgaaggaaaaacatatatcagcagtcattgtcggcgctgacagaattgctaaaaacggagatacggccaacaaaatcggaacttacggcctcgctattttggcaaacgcctttcagattccgttttttgtggccgcaccgctttcgacctttgacttgcagattgaaaacggcgatcagattccgattgaagaaagagatccggatgaagtcagacagatctcaggcatacgcaccgctcccgaagatgtgccggtcttcaatccggcctttgacatcacaccgggcagcctgatttcaggcattatcaccgagaaaggaattgtgaccggttcttacacggaagaaattgaacaattattcgcagactgtcagctgagctgaaaaaccgctgatgatgttgcctcgggcaatgtcagcggtttttttgtctgcacaatgtaatcacttcatctttttgggcggctgtaatgagatgcattttaaaaaacagctctgcataaccggctatcttttgcggacggctcattttcatcaggcttcgtcctcctttttcaccagaccaacttttttcacttaataaaatgatatgtcggacgcaaaaaaacggaacgtgccatatgttttatttttctttataggatatttgttcgatgttcagcagcaccgcttttacatccgtcttcgtgcccgcgtatcccgttaaggcgctgtttttgccgattacccgatggcacgggacaaaaatcggcagccggtttcgtttattggcttgtccgatggcgcgcaccgctttcggttttccgatcgcttcggccatatcgccgtagcttcgggattccccgtaaggaatcatcgtcagcgcgttccataccctttcctgaaagggtgtgcctttttgtctcaaaggcagagagaattgctttctttctcctgaaaaataggatgccagctgctgtttcgcctccgacagcaaagcggtttcgcacggctttacgccgggcgcgtctttccgccattcctcaaaatcttccccggtgagaaacaggccggtaataaagccctcttcctctgttacgataacggttccaaacggcgcttttacacttgtaaaacagatcattccccgctccttctttcttcggtattctgccggatcggaagcgtcaaatgaaaaaccgtgcccttcccttcttcactttccacatgaatgcgtccctgatgttcttcgatgattttatagctgaccatcagaccgaggcccgttcccctgtcttttgtcgtgtaaaatggctcgcccagacgttttaatttgtcttcggaaatgcctgttccttcatcttgaaaagaaatcaaaatgtggtcttgatcagaaggctggatggtcacgtagatattgccgccgcccggcatgacttcaatggcgttttttaaaatattgataaacacctgttttaattgattcggttcacagtaaatcggcgggatgtttccggtcaggttcagatgaatctgcacattgacaagattggcctgggcattcaaaagatcagccgtgtctttcagaatctgcgtcacgtctttttcttcatataatatcgcctgaggtttcgctaaaattaaaaattcagtgatgatagactcgatgcgttttaattctgaggtaatgacgttaaagtacagggaatattcgccttcaatgcttccttgaagaagctgaatgaaccctttcagcgctgtcatcgggtttctgatttcgtgggcgatgcccgccgccagctcccctacaacatgaagagtgtcggatttccgcagcctctcttcaagttctttggcctctgtgacatctttaaagatggccagattcatattttgaatgatatttcttttgaaggagaattccagtttgcggctgtcactgctgcttaacaggaaggggatttcattatccattccttctaaatcaatctttctggcgggaacacccgcgttttcaatatcaaataaagaaagaatatccggaacggtgtacgctctcagctcctcatccggcatgccgagtatacggcttgcgagaggattcgcgtcaataatgcggaattggttgtcaaataagaccttgccgtccattgagccgttgaatacttttctgaatttcagctcgctttcccgcaattctttttccatccgcttacgatcgctgacatttcttaaaatggttaaatgctgaccttcaagtatggttcgttttgatgtaaactcaagctctttgtattggccgttcgccatctgaaacagcatttcttcacggatttccccgtatttttcatatttcttcttaatctgcttgtattttttctgcggatcaacgataaacgtacataaattcgtctccagcagcttatccatcggcagttcgaaaatgcggcacgccgattcgtttgctttggcaatctttccgtcatcagaccaaatgacaatcgcgtccatcgcgttttcaaaaatttcgcggaatcgctcttcgcttttaaagagtttcaattccatcaaccgtttctctgttatatctctcataatggacatgtagaacccgctgattaagttggacgtaatcgtaaattcaaacagcttctcttcgccggaccgaagcttgacgggcagttctcctttggcatttccttttctgcggagggtttcccagatttctttcagatgctttttgttttcgccgtcggtaaaatggcggagcgacagatgggacaattcattctggccgatctcaaagcttttgcaaaaagagaggttcgcatcaataaacccgccgtccttatcaaacagcacgatgccgtcgacagccctgtcaaacaaatctttaaacagctgctcgttcatggagaattcgcgctctaatatttttttagaggagatgtccctcatcaccacaaaaaaataatcctccccaattccgtctctggcgaggaattcaatgtatttcgtcgcgccgctgtcaagcttaatcggcacctctttccacagatggcctttttttaaaaactttttcacggccttattcagttcttcctgaggcacggaatataaaaagtccaggacggagcggttaataaggctctctgcctcaatctgcatcatccgggccgcagcctcgttcgcctggacgattttcatttccttacggcatataaaaatggcatcaagcgtgttattcataatcacatgataccggttcaaatcactcttcaggcggtcattttcctctttcatccgcttcagctgctctttcagcgactcgtttgtttgcaaatccagagtttcagccattcagtacactccttcttcaaaaacctatccttcaatatttctacaaaatacctcatcttccttcattcgccctatacatttcagaaaatttcaatgatatgacaagttaaagtctttttctacgatccttacctccccgttacatcatcctaacaatcccttttgtcctccttcaattttttgttttttattttaaaatgaacaccaacaggaaataatcatgcagtggatgatttttgaagagaaggtgatgctatgacaaaatcgcgagacagttactttgacaacgccaagtttatcttgatttttctggtggtgttcggccatatcctccggtcatttattaacggaaatgagtttatgctccatctctacaaattcatttatacttttcatatgccggcctttatcctggtttccggctatttcgcaaaaaactttaagcggaaaggttatgtgaagaagctggctgtgaagctgattattccgtacctgatttttcagggcatttactcggttttttactatttgattcaggatgaaagcatggcaagcgtcaatccgattgatccgcagtggtctctctggtttttagtcagcttattcttttggaatctgctgctttatccctttacgaagctgccgaaaatgtgggcgcttggggcgagctgcgggcttgccgtcatgatcgggtatctcgatttcatcagcagcacgctgagtctttcacggacgtttgtctttcttccgatgtttctcgtcgggttttatttaaagaaacggcactttgatttgcttcgggctaaaagaggcaggcagattgccgcgggcgtactggggattgttttcctcttatgctggtgcattgattttgattactcgtggctgttcggatcggagccttattctacattcggcacagtgtcgctgttgagcggtctgtcgcgcatcggctggtatgttttggcctttgccgccactttcagctttttggcgctcgttccgcaaaagcgttatttctttacgaaatggggtacgagaacgttttacgtgtatctgctgcatggattcattataaaaacgctgcggcagatcgggcttgaagatcacttgtctgattatcagaatttagtcatgctcttaatgttaacggccgctcttacgtccattctctccagcaatgcggtgaaaacggccgcacagccgtttattgagctgcggataaccggcttgcttcaagcggtgaaaggaacaagaaacggtgcttattcgaaataatgcaaaatacctcttaagcgttgccgcttaagaggtattttttattttttgccgtcttcttttttcttcggcttcgtctgttcaagcgtttcaatccattttccggcgttataatcaccgagctcgcttgaaaactcttcttcaagcaatttagggtccatcggctttttatggttttgcatgtctttgctgtggcggttttttttcgtcatattactcgcctccttgtttgccgtgttttgatttgcggtttgcgcctctcagtccgggatcaccgtcatattgtgttttgtatgcatctttgtccatgctctcagtcggtgtattgttgttggtcaaagcttcattctttgctgctttgcgtttcatttgatttcctccttctgtcagcaaatctgttttgaattcattaagcattttttttaagtcgcgcactgtcacgtttttggcctcatcaatgagttcatagccgatctgtccgttcggctcaagcagcacatatttaaaatcttgaatgtctccgaggccttcctgcctgatcctcattgacagctggtcttcggtaaaacgcattttttttaagttttccgggatgatttttccgtttctgacaacggcgacggtttttcctgaaaatagaaactcaaaaaagcttgatttgatttctaaatattccatcagaatcagtaccgcaataaaaatcgccgccgcgaaaatggtttcccataaattatgttcaataaacggctgaataataatcgagccgatcgaaatcatgatgactgtctgggtcaccgacagctggctgatggatttccgtccggcaatccgcaataaaaaggtaccgaccgcgatcataactaccgacttccaaaatacggcaaacaatgacgtcacctctttacaagtagaatctccaaagaaactgtttccactcatccattttacggcaataaaaaaacaccgctttctgaaaagcggtgtcagccgataatcatcctttccttcggataatgataatttgcttcgatttcttttcggccgatcaaataaaggaaagtcaaaatgccgatccggccgataaacatcacaatcatgatcacacattttccgatatcgcttaaatgcggagtaatcccgagcgacaggccggtcgttccgaaagcggaacacacttcaaaaagcagtccgaggagcgtctgatttgtctccgtcacggaaagaatcagcgtcgacccgaacacgagcagaatcgccatcatcgtaacgaccagcgacttcatgacatcagcctgatgaagctcgcgtttaaagaccttgaccgctttattccctctggcaaaatgaaacagagcaagaaggttaagcgcaaacgtcgtcgtacggattccgccgccgaccgagctcggtgatgcgccgataaacatgagggcgcagatgaaaaataatgtcggcgccgacagctggctgatatcaattgtcgcaagcccgccgcttcgcgtagcagttgattgaaagagacataaaaataaaacatcatgccagcttttccccttcataacatggcttgcttcaagcgcgtaaatgcccacggctccgaacaaaacgagcattccgaacgtaacggtcgtaattttcgtaaacagcgtgaatgagtatctgcgctgttttgaaaacaaaaagtcttttacttctacgagcaccggaaaaccgatcgcaccgaaaataatcagaagcatcgtaataaactgcacgaaatagtcatgtctgaacgggacgagtgaatttcccgtaatatcaaagccgccgtttgtcgtggcgctgacgctcgcaaagaatccgtgcaagtacgcctgttcaaacgaatcatagtatgttaaaaaatatgttcctaagatgatgccgcctaaaaactcgattaataaaatcaaaaacagcacttgcttcatcaggttgacgataccggaaaactgcgattgattctgatccaccataatgagcttccgttcccgcagaccgatccgtttgcccataatgagccagacgaatgttccgagcgtcataatgccgattccgccgaattgaagcacgaaagccaaaatgacaatcccggccgtgctgaatgtatcagccgtgttgacgaccgttaaaccggtgacactgactgagctgacagccgtaaacagcgcgtctataaacgaccagctggccccttgtttgtgggcggccggcagacttagcaaaataaatgccaccgtcacagcaagaaaatagtataatgcaatcagctgtgcaggcgacaagatctgtatgaatttcttcagttttaatttcataagatagttccttctgcctctcaaatgtagtacgtaattattctaatgatattgggagaatttttaaaggccttttttgaaagatttttcattaccttatgtaatttgccgatctttaaacaaaaaacctctgaaacgattgtcagaggttttgtttattattttgcttccagcctgcggatgcgctcatcgagatcagggtgtgtggagaacagtgacgaatgctttttgccgttaatttttaacgtctgcaccgccgtctggtcttcttcattcacatgtcctgtataagacttcagcgtacgcagggcgtgaatcattttatccttgccggcaaggtctgcaccgccgcggtcagcgtgaaactctctgtggcgcgagtaggcgaagacgacaagactgccgagaatggaaaagataatctgaaacacgatcatcgcgataaaatgcacgaccggtgcgaggtcttctttgacaaagcggcttgcaacccatgccgcgattcgggaaaggaatacgacgaacgtattgacgattccctgcagcagcgtcatcgtgaccatatcaccgtttgtgatgtgtgcgacttcatgggcaagaaccccttccaccgcagcatcatccatctgctgcaataaacctgaagaaaccgcgacaagcgaacggcgcttagaaggtccggtcgcaaaagcattgacctccggggactgataaatgccgacttcaggcattttcgtcatccctgcggcacgggacaatctgtgcacacggtcaaccaattgctgttcttcatagctgagtgactgtttcttcggatttaacacccggacgcccatcatcgttttggccatccatctggacattccgagagaaataaaagaaccgacaaaaccgacgacaagactgaacacgagcaatgccatcagatcaatgcggccattttgtatatacgagccgacaccggtaacgcttgtaataatcgtaagcacaattccgattgtcgtaatgaccaaaaggttcgttaaaataaacagaaatattcttttcgccataattacctccgtcttttttaagatcaaaagaacttatttaattaaattataaatgatctgtttgaaaatgcaacaatttcgacgtatgatgtaaatgtaattctcagtgatatcagaaagtgaacacgtaatcaatcagaggtgaaccatgaacacgtttaaactgacccgaactgatatggtccggcttctttacgcgttaaaaggccaaggagacgcaactcctctccaaatcttattgcaatcagcggaaatgacattggatgaagcggaaagccgtctgcatatccctgaatttctgacgagattcgaacgaaaaaaagagaaaaaggaatacgggctttcaactaacgagattgtcgagctgggaaatctgtgcgagctgacgtctttaaaatcaaccgccgtccaaaactgggtgaagcgcgatattaaagatttaatcggccaccccttactcggcaaaaaatatacaattgaacaagctgtcatccttctcattgtacgtgatttaaaatcaatttatgacttcgaacatatacgcggcatattaaaaatcgcttttaacacgatcacagacagatcagacgacgtcatcagcccgatcagctactatgaaagctgcgcccaagtgattgattatcttcatcataaagcaaacccgccgatgaaggaaacgagcctgcaggagctcgtcgaagagcagacggacaagctcaaaggctgctttaaagaactcggaagcggacaatggaacgatatcagatccatcatcgccgtcacggtgctctccgttttgactttccatattcaagcctcagcctacaaaatgaccagccatttattataattcataacgcttcttcgccccggtgtctgcgccggggttttttgctgtacaacaattgccagcataatcaataccgttccgtttgaaactaaaatgcgtaaacacatcttgccagagaaaaggagatgaaaaagatggcgagcagaaataaactcttagttccaggggctgagcaggcacttgaccaatttaaatacgaagtggctcaagaattcggcgtgaaccttagctctgatacagcagcacgcgcaaacggctctgtaggcggggaaatgacaaaacgtcttgtacagcaggctcaatcacaattaaacgggaaaaatcaataatgcagcttattcgccgggacttctcggcgaattttgatatttatcggcattctcctttccgtgccggtagccgttcggattcctgcggtctgacgaatcttcatgatgccgataggagtcccaatgttcattgcgatcatgattccgctgattccagtaatgattgtaatacttttgcttaggctctttgtcatttccgttttcctgaggattttgtgttgggggctgctctgtttccccatcttgttccttctgtgtgttttcttctgatccggaagctgcatttttgtcggtttgctgactgccgtcctgactgtccggcttcgcttcttccgtgccgggcgttgtttcattgttttccggcttctctgctgccttttcttcatcaggagctgtcttttcatcagccgccggcttttctgtgtccggctgtttgctttgatcagcgtctgtttcggtatctttttgatctgtttcattgccgtcggtttgcttttcagactgtttttcttctgttttcttttcgtttcttcttatgtagctgcctgttgacatcccttcctgttttgctttttctcttgtttccatatcagattcaagagattggacctggtaggtgcccttatatttttcagtcatgtcagccagctgttttttaacgccttttttatatgtattgtcatctgtattttcataaaccgtggaaattaaaatctcttttgattcctttacatatccatgcttgctgcaatcggtaataatattattgatgacttccttaaaatcgctgcttttccaatctccgatgtcactgatgacctgtttggcgtcatggttcagcggtgtcagttcaatgacttcatatttgctgtttaaagccatttcaatgctgggattaatgtcaagcgtcatatacgcgtaagctttgttatcagaaaaaaccgggagcaaaattaaaataaacaaaataatagcagtcatcgtaaacactcccaatttaaaagggcgcagtttcagaaaatcaaaaaagctggcccttcttcccatacgcgtttcgccttcgaacgtaatttcctctccgatttcacaagtgcggtgatcattttttgtttttaaaaattgtccgtcaggggttagcaacgtgacgaattttttatttttctctactatgatccctcttctcatgagtgcaacacccctttaagataatcttttaaataaatataatcaccggtaataataatactcatggcgatgatatattttcggttccgttcaatcgtttttctgctgaccgacacaagctgctccagctgtttgacaggaagctgttttttctggtgcaaaatggacgccagctcttcattttcaacaagcgtgtaggctaccttaatcgcattctgcctcgcatcagtatgcttcggcgattgttccagcagctctttaaaagacaggccgtattctttcagctgcttctgaaaaaaaagaatttcttcccggcgctgttcctgttctatctgtttgcggtattcatcaatggaaagctccgcttcgataaggctctgcgaagattcctggtcgtcgccctcctgcacatccatattgatatgctgagcggttcttgcttcttttctgatatagtctatcacttttctttttataatcagctctgcaaatgcaagcagcgaattacctttttcagccgaatacttttcaatagcttcgttaaacgcgatcagcccgatgctgaattcgtcgtctttttcatctatatatcgtttacaaacggatgaaaccgtcttcgcgataaaaggcttatattgctgtattaaatcgttctgcagatctttgtcgcctttttgtattttttcaacagatgtttcaagcgtttgcttcttttttcccaatttaaacaaaaggctaagcactggtttcacctcagttcctccctataactactcataatcatagctaatttagtagggattcgcaaaggaagaaaaagagaaatcgatttcatttgtctcaattatgacaagccaataagacgtactatacatgatttcgtgcccccatgcagaattaagggggttttctctgtgttttttgtaacaatgctgttataaaattgttatcatatgtcttaaatgtaagcgcttcaaacaaaaaagggaacctgctttctaaaaagccagactccctttttgatcattttacgcgtgttctcttttttccgatgccgcgccggactctgtttgttttgctcctgacataaaccatccgcaaaccgcaatggcagccagaaccgcccagaaaatgattttccaggccgccgaatggatgacatctgccggaattataccgagttcctcatgggccaacgtataaagagcgagcttcacgcctacccatccgacaatcacaaatgccgccgtttcaaggcccggcctggttttcagtaaggatacgaacattgatgccgcaaaacgcataatgattaaaccgattacgccgccggctaaaataacgagaaactgaccgccgtccaagccgccgatggcaggaagccgtgttcccggaagcgttacggcaagtgcgaccgccgctaaaatggagtcaacggcaaaagcgatgtccgcgagctccactttcaagacagtctgccaaaacccgctttctttctgcgttttctgcccggcgttatctttgaatacataccgcttcagcaaatggctgaccgcaatgtaaaacaggtataaagcgccgacggcctggacctgccaaacattcaccagaaatgaaatggcgaacagcgacccgaaacgcaaaataaatgcgcccgccaatccgtaaaataaagccttcttcctttgtttttcaggaagatgcttcaccatcacagccatcaccagcgcgttatccgccgccaaaatcccttccagcccgattaaaacgagaagaacccatccatactccaataataatgcaaagtccaatccattccctccgtttcttttttctatcatccgagcttataccggcggtttttttacgcaaaaaagacctttgccgatataaggcaaaggtcttgctagacatgaatgattggcatgccaacaaagtcgatggatatgatccatgaattgacgactttgtttccggaatatccggacgctactcccctttgggatttcaagaaatatttgtttatacgctcatgataaagcctgtttcatcatttgtcaacgcttaacttttttaacaaattgagaaattttttctgttttgacccgctgttttcttctcttcaaaaacatccaaagaacgagaagcaacacaatgaatataccgagcggcagcatatattgatcgagaatggaaccgacgcttttccaattttccccgagtttcataccgaggtatacgtaagcaaatgtaatcggcagcatcgctgcatatgtatagagagagaacacccagatattcatcttcgcaatgccgcacggcaaagaaatcagcgtcctgacccccggtataaaacggccgctgaacgctaccaaacctccgtgcttctgaaagaaatcatctgatttctgcagaaattcgggttttatccatatgtactttccatatttcagcaaaaacggccgaccgcccagcctgccgatcccatataagacaagcggacctgaaacaccgccgagcgaaccggcaaacacggctccggcaagcgtcatatccccttttgagacccaatagcccgcaagcggaagaacaatttccgccgggatgaattctatactgagcgccaaaaaaattccggcgtaagataagcttttaaacgcttcaattattgatatgatgaaatcttcgatgatctatcactcccggcttacgtctatattctgaaacttaagaatgattttaacacaaaaccttgaggctgaaatatcttttagacatgcccgttataaatatagtcgtttcagatcggtatagcgggagggaatgacatgcgcaatacaacgtcccgcctgtctcctgaatgctcgtctggcggcggttacatcacttaagatctccggaaagttaccatttgcggtaagcggcgctgaccggaattcagttcatatgggcagtgcgttttgccgggatctttgccatcgccgaatctgtttttatgggagcgggaaattctctcggtcactacatggaaatgcgtgggcatttcccggggaatgattctgtataatttttttgatcaaccattgatgattttcggggacttcagcgatttaaagaacttaccgattcacatgcgatttccttttcagccggctattaccgcatgaggaaatagaatagccgctccatgaacgccgcatcacccataagttgctacacatggaacggacccgtttatccacaataaagacaaaaaggagtttttattcatgcacacgatgtggaagggttcgatcagtttcggcctcgtcaatatcccggtcaagctctttgcggccactgaagataaagatataaaattccgcagtcttcataaagaagaccatgcgccgattaaatacgaaaaaatctgcaccggatgtgaaaagagtctggagcctgatgaaatcgtgaaaggctatgagtatgtaaaagggaaatacgtcattatgacagacgaagacttgaaagacgtaaaacaggaacatgaagaaaaagcggttgagattgttgactttgtccagctgcaggaaatcgatccgatttattttaaccggtcatattatgtcgggccgggagacaacggcacaaaagcctatacacttctgcgggaagcgctgaggacgacgggtaaaatcgggattgcctccattacgatccgctctaaacagcagcttgcgattcttcgcgtgtatgacaactgcatcgtgatggaatccattcattatccggatgaggtcagaaatgccggacatgtgccgggcgttcctgagcagacagccgttaatgaaaaagagctgcagacggcgatcacattaattaatgagctgacaaccgagtttgacccggaacaatacgaagacacataccggaaagcccttctcgccaaaattaacgataagctcgaacatgaagaagcgggcgtgacacctgctcctgccggcccgcgagaagatgtcattgatcttgtcagcgcgcttcaggcaagcattgaccggacgaagcggccgaatcgcgaacaggctgcaccggcacggacaaaagacacagcgtcagctggcggcggaggcaaaaagcagaagacgaccagacaaaaagccggaacgtcttaatcatggtgctgacgatgcagccgattttgacctctgtaccgcctgaaggcagtgagtggcgctatgaggtaaaatatgacggattccgctgtcttctccgcatagacgaaaacggtgttacattaaccagcagaaacggacagacgctgacgaatcaatttccggaaatcacggcttttgcggcccggtgttttcagcacatgaaagacaggttccccattacgcttgacggagagcttgtctatttaatcaatccgtacagagcggactttgagcatcttcaaatccgcggacgtttaaaacgaaccgaagcaattaaaagcaccgctgatagacggccgtgccgctttctggcatttgatctcctcgttctggaaggcgcgggcaccgtctcattaccgtatgtgaaacggaagcgcgccctttccaatctgcttaaagaagcaaatcttcccgcctgccctcatcacttagcggaagaagcgattcaatacattccggagcacactgactttgacgcgctttgggacaaggtcgtccgccatgacggagaaggtatcgtagccaaaaggacttccagcggatgggcggaaaataaacgctctcccgactggcagaagtataaacatatgaaaacggctcacgtgctattaaccggattcaatccgaagaacgggtatgtgacggcctctgttttgaaagacggcatcgtcgtcccgatcgcttccgtttcccacggcatgcaggcggaagaaaaaaacgccgtcagaaccattatggagacccacggaaaaaaacaaaaaagcggcgagtatacacttgagccttctatctgcatgaccgtgcagtatttaaccatattgcaggacacgctgcgtgaagtatcttttgtgtcctttcagtttgaaatggattggacggaatgcacgtatcagcagcttatcctccgctctaaaacgctgccgccgaagctgcagttcacaagcctggataagatcgtttttaaaaaacgtgaaaaaacgaaagcagatttccttagttatatggtgaaaatgagcgattttctgatgccctttcttaaagatcgggccgtcacggtgatccgttatccgcacggcgcgcctggcgaatctttctttcaaaaaaacaaaccggactacacgccggactttgtcacaagcgtgtttgacgggagccacgagcacatcgtatgcagcagcgtaccgtcacttctatggctggctaatcagctggcgcttgaatttcacgttccgtttcagacagtgcattctgaaaggcccgcagaaatcgtcattgatcttgatcctccgtcaaggaatgattttcctatggcagtggaggctgcgcatgtgctgaaacagctgtttgactcattcagcatgacgtcattcccgaagctctccggaaataaaggcattcagctttacatcccgctttcaccggaagcattcacctatgaagaaacccgtgcgttcacaatgctcatcgccgattattgcgtcaggacgcgcccggatctttttacgacagagcggtttatcaaaaaccgaaacggcaggctctacctagattatttgcagcatgccgaagggaaaaccattatcgccccctattcgacccggggcaacgaattgggaacggttgcggctcccctttattggagcgaagtcaactcctctttaacacctgatgattatacgatcgatacagtagtgaaccgcgtcaggacagagggagatccgttttatgatttttaccggaatccgcaggacggcccgctttcaatcgtgcttgagcaaatcaagagaaagagctgacgcttttggtcagctcttttcagtctgatacgtgcacatcaatttttctttggaaataaataaatagcaggagtaaggaatgtttttgagggtgagctgttttgcagtaaagtataaaatcggaagatgggccgctttcttaaacagcctgtagcagccgctggacggttttatcacatcaaaaccgagtctcgccgctcctttatgaagcattgtaatgccgacgactcccttaatctcgtctttccgtttatgctggttaatataatccgctaaatgaggcatggattgatataccttctgatatagcataatcccccttctgaccgcgctttcaataggctgcagctctttcaggagtttgacattatgaagatgaatcttaactaacacgtcgttttttttaatcctggttccgtcgctcaggatgacatcttttcctttatatctagtcaaacggacgcggaatacattcgattgccgtttatcaatcagcgtcagccgggtaaagaagaaataaagcggatcaagtaagtaccatatagacagcagacagcttctcacatgttcaccttctttatattcaaagcaccctcatattttggcatgaggcatgacacattatgattggtaaataatgatgcagccctgtatcagcttatgcaaaaaccgcttcaggctctactgtccgaaacagaaaaaaacactcttcatgaagaagagtgtctgtatccgctttcttttaacggaaaagcaaatgctggctgtgaattcctgcttttttcagtaaggctatcagctgttcctgttcctcaggcataagtcctgaaaacgctctcgcaattctcaatgaatgaatcggataaattttatccaaatactcgtttcctttatcagttaaatgggcgtaaacagaccgtttgtccttcgggtcttgttctctgaccaaaaacccgtttctttcaagcttgtcgatgacataggtgacattcccgctgacaagcaaaagacgcgacccgatttgctgaagcttttgcggtcctctcgtatagagcagctccaaaacggcaaattcagtcggattaaaaccgtgttctttactatcgcggatgctgtgttcagacacactcttgaaagcccttgcaaaaactttgtacaaattcatcgaacgcatcacttcttcttcgttaaatgataatctcatcatatctaccccgtatttaagatttttataaaaaaataatgtaaacccttacaattcataagagtcgttctttgttttatattctattcgtgccgtttttcagaattccttcttttttatataaaaaaatacccttatacatcatttaatttgtataagggttccgttctttatagggaatgttccgaaaaaaatacgcgtattcctttctcagctccgtaattgtcatggaattaagtatttctttcgtatagactccgatctgcagaagctttttggaataatggtttctctctttatccaatgcattttgaagcaaacgactcatgacggcctcctttgttttccgttattctatgatcagaataacgcttttatatcaaagatgtataaagccattgtaaaacttctgtagattatgatgtttttcggtaaagaccgttctggacggctctgagcagcggaaaagcgtgttccccggcaagctgcatgaacgcctccagcatttcatcgcgtttcatatctaattcaatgatttcttttgccagcgaaaccgctttttctttctccattcctatccttcctcctcattgtatctgtacaataagcataaaacgggggcacagaaccatgcattaaccttgtcaatttttctgccgctttttttctaaaattttctattccgcgtcagaaaacctgacaagcgtcaggttttttctctttttttcttatataatatgagtaaaagacatccaggggtggaaaaatgacgacagacgaacaatcttacaaagataaaaaagtaatctcgatcggcattgtaagcgaattaaccggattgtcagtcagacagatcagatactatgaagaacggaaattaatctacccgcagcgatcatcacggggaacgagaaagtattccttcgcggacgttgagcggctgatggatattgccaacaagcgggaagacggcgtgcagacggctgagattttaaaagacatgcggaaaaaagaacaggctctcaaaaacgacccgcagctccgcaaaaaaatgctggaaggacagcttaatgctcattttaagtataaaaaccgctgatcaaaaaagtccgcctcctgtgagacggactttttttataaagcatgaagaaatgcagttgcaatgccgaaataaattaataaggacaaaatatcgttcagcgtcgtaatcagcggtcctgacgcaatcgccgggtcaatgttcagtttatgaagaataatagggacgatcgttccggccatcgtaccgataatcaacgttgcaagcagcgatgaaccgacgacaaaaccgagcgttaagtctttctgccagacggttgcgacgatcgtaatcgcgatcgcacagacgatgccgatgtagataccggttcttaattcacggaaaatcagtttaaagatggtttttttattcatttcttctttagccagtcctctgatgacgacggcaagtgactgtgtgcctgtattacccgtcgttcccgcgatcatcggcatgaaaaacgcgagggcgactactttttgcaatgtatcttcaaaataattcagaatgcttccggaaatcaatccgataaacaaaagcagaatgagccacggcaaacggcggtacgccgccacgtatgctttcgtatcaaatgtaatcgccttaccggaggctgcgaatttttcgtaatcttcatcggcttctttaatcacgacgtcaataatatcatcgacagtgacaataccgacaagcacattattttcttccacgatgggaatggctaaaaagtcataccgctggatcagccgggcgacttcttcctggtcttggagcaccccggccgagatgacacgcgtaaacatgagatcctgcactttatcgtcaggctcgccgagaattaaatctctgtaagagagcactccgacaagctgcttgctgtcattaatcacgtacaaataatttattgattctgcgatttctgcaaagcttttcagcttcacgaccgcatcttttactgtataatgctgcggaatccagacgaagcggttcgtcatcatccggcccgccgattcttgcggatagttcatcaaaagctgtacggcctttgattcctcagcctccatactggataaaagctgttctttcagttcttcatccatctcttcaagcaatgcggcgagatcgtcgttatccattttattcattgcgagagtggctttcgttttaccgaccttatgcaaaacggcaagctgaaattcccgctccagctctccgatcatgtcggtgatgtcatcaaccgtcatatatgacagatagcgggcccggtgcttttccggcatttctttaaataaaaatgccatgtcatagggctgaagctcatctatcatgtttcggaattcttttatttttccgtcccgcaataaaatgataatgcgtaatatgagttcgtcataggtcatgttttggaccatcgggactcgtacctcctttacggagacgcgccgtccgtcaagggaagtgcggcggtttgtctcctcatcatgtcgtcactggttatctggctgtatatgggtacttcttctgacatactcgaatggggagaatccatactccgcacctccttatcatgctcagtcgtgtacgttttgaggcataaaaaaaaccttccgatatgaaggcgaaaacaagcacggcaaataaacgtgcggggcctccaatcgtagagctttagcactgtatggcataggacagccatccagctgcgttaagaatcaccttatgtcgatgattcctgttgacccattggcgtctttggacatttttgggcagcagcgtatctccatacaggagcctcacctaacgaagttcttatttgaattgacacactgagattacagaaaaaaaaggaatgtgtcaaccttaaatttgtgatttcagcacatgcctataaaataaacggaataaaggcataaagcccttattccggcaaatcgctttcatcgtcttctgaaaggaaatgataggattcatgcagcatgagcgcgtattccccttcttttgtcggatgcggtacatactcagcctcgttgatatactgctcttcccttttcttcatatgacagacctccttctcaattttagattgtccaaaagaagctccgttatcataggaaagaaaaaatcacttgcggaacgggacatgcagctatatttttcggatcgtaaaaaagttcctaagcagccacgggcccggtttgaaaccgagcgttaattgccacgcgccgatcgcctgcagtccgaactcccgaacgagaaccattttttcactcatgctccgcacatcctcaaaccacacttcatgcgttcttccattttcatcagtataccggaagtaaggggaacgctcctgctgggaataacggatcattgattgatgcttcatcgccgtttccatggcgcgctgattggagatggcagatccgatcgttccgggacggtacggaatcacccaatcatacccgtacagcggaacaccgagaatcacttttcttctcggcaccctgctgatggcaaaattgatcgtttgcctgacctctgttaaaggcgccacgggtcccggctcactgccggcgtggtgccagtcgtacgccataatgaacatataatcgacgacggctccgattccgccgtaatcatatcccctcagccacggcactgcatcacttgttttcgccggaaccgatatcgttaacgcgagctgatgctctgaaagccgggtttttaactgccggagaaatcctgtgaagagatccctgtcagcttctctgacccgttcaaaatcgatatttacaccgccgtatccctttcttaccgttaaggagacgatattgttgacgagattcgttcttgccgccggattctgcagcacttgatgggctaattccggactgaatcccccttctgtcagattcgtaatgacggcaagcgggcgcactctgttctgccatgtggtttctattgcggttctgtcgtttaaatcgttcatgatatctccattcgggccgaaatgatattcaaacaaagaaatcgccgaagaatacggcgcaaaatcattaatcagctctctatccgcttcaggcgtccgaatgacataaaattgcagggttcccgcaagatagttagagatatcagggatcttcactttcatacccgtccgcagccggttcggcggaatatccgggtttgcctgcatcagctgcatctgcggcacataagccttacctgcgataacggcatacgtatcattcggctgaaccgtatattcattaagagggattaaaagcgcctgccccggaacgatattcgtttcctcaagcccgttgacgcttctgatgctgtcaacagggtatccgtactttctgctgatggaaaataacgagtctccagactgcactgtatgaacaaacatagatgtcctccgtttccttttgatcaaaagggctcttcttatctttatgaatgatcttccggtccgattccaaactctgttcggagaaaggctgtttacaaatcagacatgatcaactatgatgatgtcattataaaaaactgtataggaaacgcactaggggtgctgttatcggctgagataaaacatgcggcaggcgtgttttgatcccttataacccgatctggataataccagcgtggggaagtgcagattgaccggagcgcagggtttttccccatgcgttttcgttctgctgctgcatattccctcggatatgcagttttttatttttcattaaaaaacgggggaggacaccgcaatatgaaacttacgatcaatcgtctttcgtaaaatcaactctttcatacttacgactatcgataagaaagcaggagatcacaatgaaaaattggaaaatgagagaaattgtcgtcatgtccgtcatcagtgttgtatttgctgtcatttatttagtatcaactcatgcaagcaatatagcggcaggatttttcggccggatgagctacgaaccgatttacggtatctggtttatcgtctcggtgattgccgcgtacattattcaaaaaccgggagcggctctcgtttctgaaatcatcgccgcgtttgtggagtgcttactcggaaatccgtcaggaccgatggtgattctgatcgggatcgcacagggaatcggtgcggaagcaatctttttagcgacacgctggcgggtgtataccctgcccgtgcttcttttatccggtatggggtcttctgtgacaagcttcatttatgacttgttcgtttccggatactctgttttgaatccgggtttattagccgtcatgcttctcatccgtctggtctcaggtgcgcttcttgccggccttctcggcaaagcaatcagtgatgcgctggcttacacaggagtgctgaacggcatggcgctcggaaaacaattcaagaagaaaaagaaacaggtgaaccaagatgcaggcatctgaaccccttctatccgccggccgtcttaccttttcttatgatcaggatgaaaagccgatttttcaaaacgtgtcctttcagctccgcaaaggagagcgggctttattgctcgggccgagcggatgcggcaaaagctcgctcgctctctgtttaaacggtctgtacccggaagcatgcgatggggttcaatcgggaaccgtttctttatacggaacacctctttcacacctgacagaacccgccgccagatctatcggcgtcgtgtttcaagatccggaccagcagttttgcatgctgaccgttgaagatgaaatcgccttcggcctggaaaatttgcaatatacaaaagaagatatggacgcaatcatcgatgacgttttagaaaaattagagatcactcatctgaaaacgcgaacgatcgcttcgctgtcaggcggttcaaaacaaaaagtggcgcttgcctgtatcattgcgatggaaccggaactcattattttggacgaaccgacggcacagcttgatccatattcggcacgtgaattagtgcggctgatcaaagatcttcaagcaaaaaaaggcttcggccttctcgttatcgaacatcagcttgatcactgggcgccgtggatggacaggacgattgtccttgacgaaacgggtcagaaggtgatggacggagagacggatgttatctttgaaacaaggattgaagagctgatacagctcggcattccgattccgcgtgtgatctcattgcaggagcacgtcagcattccttttacattgtgtaaagaaaatctgtttcacgaacctgtaccatctctgcccgaaccccggcccgccgcgctttcggcagaagacgcgctgagcgttcacgaactgtcattctcaagaggagcagaagtcatttttcaggatgtgagcttttccgtaaaaaaaggttcaatcaccgcgattgccggtcctaacggaacaggaaaatccacgctcctttctgccgcggccaagctcatccgtccgctgggcggagacatcaaaatagacggcagaccgattgattcctattctgaaaaagagctgcggcgacagatcggatatgttttccagaatcctgaacaccagtttgtcacagattccgtcattcaagagctgatgttcggttttgaaagcaacagagccgcaaaggagaaagctcttcagctgttaacccgattcggcatgagacgccatgcctcacagcatccgttttctttaagccaaggacaaaaacgcaggctcagcgtcgcgacgatgcttatgcacaatgtgaacgttttgatgcttgatgaaccgactttcggacaggatgccaaaacggcgcgggagtgtatgcaaatgctccgtgagattcaaaaggaaggaacggctgttttgatggtgacacacgatatggaactcgtctcggattatgccgacacgatccttgtgctctgcggcacgaagctggtgtaccgcggaacgcccgactcattgttttctgatcatatcggaatcgcggagcgggcgcatttagctttgcccctgcggtatgaatggatgaaacacgacaggaggcggaaaaatgaacttgcggctggaggctgttaacccgtcaataaaggcggcggctgtattgttatgcgtcattatgctgtcatttatttataatccgtacacccctgctttgttttatatcatcattgcgggaggcgtcctctcggcggggcgtgtgccgctgaaaaaatggctgctgttcacgattccgtttgtcattctggccttcggttctttatggacagccgccgtattcggaaacgtcccgacaaccgggagcaatctgctgtttaaactcgggccgattgccgtcaacagtgataacgcggcgctcgggatttctatcgcgtttcgtattttatgtttttccgctttgtcgatgatgtttctttttacaaccgatccgattctgttcatgctcagtctgattcagcagtgtaagctgccgcccaagcttgcatacggcgttatcgcgggattccggtttctccctcttctgaaagatgaaatcctgatcatccggcaggcgcacagaatcaggggtgcggcgtctgattccgggctgaaaggaaagctctccgccttcaggcgcttcaccattccgctattggcaggcgcaatcagaaaggcggaacgcacggccatcgcgatggaatctaaaggctttactgggagccgaaaccgcacgttttacagaactgttactgtgcgccgcgccgactggtgctttttcctgctcgtgcttctgttattcggcgcaagctggctcatttcattgttgtttgtataaaaacaggccgccggagtgattcggcagcctgttttgttatgtatgttattgatgataattgagagcctgagcgagattggacttgaccgtaatctctgagaaattaatgccgagctgtacggcggtttgagcaatttccggcctgattccggataaagtggacgtgacgccgatcaatttcagcgcttcaattaatttaaaaatctgatgcgccaccatcgtatcgacaaccactacacccgacaggtcaattaacagatgttcaatcagccgttttgcacatgtgctcagcgtattttcaagaatgaatttggcgcgctccgtgtcaatatcgccgacaagcggcagcagcgccgtccgtttgctcagcgtgataaccggcgagcttaactccaaaatcatttctctttgcgcattcagctgcatttttgagttatgctcagcatgatcgacaaacgtgtaaatcgtaaaatcaaatacttgtgcaattaaattctcccatttcttcctttctccctcggcaaacgaagattcatgtttatcggcaaacgcatcataataactgatgtatagtctccggtttctcatgaattcacggaccacatactggacgggagtatccagatgcttctggtctttcgcaagctcaatcacccaccgctcgaattcttctaaaaattctttttccggcatgatatacattttattaatatgccggtaaaattctttatcctgctccgtcagttcttctgtgatgacgggatttgtcaaagaataaatcgaattcggatccgaatcttccatcgtttcgatccactctttcgcaatttgatccacttgttctgaaaaatagctgtataacgcttcatttatcttcatctctcttctcctttcccatttccaattatagcgtcagcgggtcatgaatgaaaatgaaagctgtcaaactatccatttatttgaaattttttagtccgatagattacgccttttttatgaaaatgcttcaaatgactctttccggccggcatgctctgccataaaatagtagcaacacccttgtatccactggcaagcataaaaaaggagggcttttttatgaatggtgaaatgcatttgattccttatgtcacggatgaacagatcatggatgtgaacgagcttcctgaggggattaaagtgattaaggcgccagagttgtgggcaaaagggtttaaaggcaaggatattaaaatcgcggtccttgacacaggctgcgacatcaatcatcctgatttgaaagaccggattgtcggcgggaaaaacttcaccgatgatgacggaggcaaagaagacgtgatttccgattacaacggacacgggacacacgtttccggaacgattgcagccaatgattcaaacggcggaatttcgggtgtcgcgccggaagcaagccttttaatcgttaaagttctcggcgggaaaaacggcagcggcaaatacgaatggatcattaacggcatcaactacgccgttgaacaaaaggcggacattatttccatgtcactcggcgggccaagcgatgtgcctgaactgaaagaagcggtcacaaatgcggtaaaaagcggtgttctggtcgtttgcgcggcaggaaacgaaggcgacggagacgagcgtacagaggaactgtcgtatccggccgcttacaacgaagtgatcgcagtcggatcagtctcaatcgcccgtaaatcgtctgaattttcaaacgctaataaagagattgacctggtggctccgggagaaaatattctctccacccttcccaaccataaatacgggaagctgacgggcacttcaatggccgccccgcatgtgagcggtgcgcttgccttaataaaagggcttgaacaggacgcgtttcagcggacgctttctgaggctgaagtctacgcccagctcgtgcggcggacccttcctttggacatcgccaaaacattggccgggaacggatttctgtatttagacgcgcctgaagtgctgatggaaagagccgaacaggcacagctgctgtctttctgatatttttctcgtataatgattgatcagtttgtcacatcaccaatttttaaattgtgagattttctattgacagtgatctgaataagctgataagataaccaacaaatgatgtaacttttcaaaaaaattgaaatactttctcttatcgagagttgggcgagggattggccttttgaccccaacagcaaccgaccgtaattccattgtgaaatggggcgcgtgatttttgcgccgagacgattgtctcataaggcacggtgctaattccatcagacgtgatctgagagataagagaggcttgcattttgaagttaaagcctctttctctcatgagaaagaggcttttttgttacatctcacttaaaggaggagacttaatgacaacaatcaaaacttcgaacctcggttttccgagaatcggcttgaacagagaatggaaaaaagcacttgaggcttattggaaaggaaacactgataaagaaacgtttcttaaagagcttgacggtttattcttatcagctgtcaaaacacagcttgaccaacatatcgatatcgtgccggtctctgatttcactcattatgatcatgtgcttgataccgccgtcagctttaactggattccggaaagattccgcagcatcacggatcccgttgatacatactttgcgattgcccgcggtgtaaaagacgccgtttccagtgaaatgacgaaatggttcaataccaactaccattacatcgttcctgaatatgacgaaagcattgaattccgtctgacgagaaacaaacagcttgacgactaccgccggatcaaagaagaattcggagcggaaacgaaacctgtcatcgtcggtccgtatacattcgtcacgcttgcgaaaggatacgaagaatcagaagcgaaagcgattcaaaaacgccttgttcctctttatgtgcagctgctgaaagagcttgaagcagaaggcgtcaaatgggttcagattgatgagcctgcccttgtgacagcttcttctgaagatgtccgcgccgcaaaagacctctatgaatctattacaaaagagctttcaggactgaatgtcctcctgcagacatactttgattcagttgatgcatatgaagaactcgtttcttatcccgtacagggaatcggacttgatttcgtgcatgataaaggcagaaaccttgagcaattgaaaaagcacggcttcccgaaagataaagtgctggcagccggtgtggtcgacggccggaacatttggaaaatcgatgtagaagaacgccttgatgcggctttggatatcctcagccacgctgatgttgaggagttatggattcagccttcaagcagccttctgcacgtgccggtggcgaaacaccctgacgagcatcttgaaaaggatttgctgaacggcctgtcatacgctaaagaaaaactggcggaactcggcgtcttaaaagaagggcttctgtccggcaaagcggccgtcagtgagcagatcgaagaatcaaaatcggcacttaaggctttaaaagcattcgcaacaggagcgaactccgctcaaaaagaagagctgaatcagctgacggaaaaagatttctcccgtccggcaagctttgaagaacgattggcgctgcagaatgaatcactcggtcttccccttctgccgacgacgacaatcggaagcttccctcaatctgccgaggtgcggagcgcacggcaaaaatggcggaaaaaagattggacggatgaacagtaccaagcctttattaatgcggaaacgaagcgctgggttgacattcaggaagaaatcggcttagacgtgctcgttcacggagaatttgagcggacggacatggtggaatacttcggtgaaaagctggccggattcgcctttacgaaatatgcatgggtccagtcttacggttcacgctgcgtacgtccgcctgtcattttcggagatgtcgaatttatcgaaccgatgacggtaaaagatacggtctacgcccaatcgctgacggaaaaacatatgaaaggcatgctgacgggacctgtcaccatcttaaactggtcattcccgcgtgtggatatttcaagaaaagaaatcgccttccagatcgggcttgccctcagaaaagaagtaaaagcgcttgaagatgccggtattcagattatccaagtggatgaacccgcgctccgcgaaggactgccgttaaaaacgcaggattgggatgaatatttaacttgggccgcagaagcattccggttaacgacgtcttctgtgcaaaatgagacgcagattcatacgcatatgtgttacagcaactttgaagatatcgtagatacgatcaatgatcttgacgcggatgtcattacaatcgaacacagcagaagccacggaggatttttagagtacctgaaagaacatccttacgtgaaaggcctcggactcggtgtatacgacattcacagcccgcgtgtgccggcaactgaagaaatctatcaaattattgatgacgcgcttgaggtgtgtccgactgaccgcttctgggtaaacccggactgcggactgaaaacaagacagcaggaagaaaccgttgcggcattaaaaaatatggtcgacgccgcgaaacaggcacgaaaaaaacaagctcagcttgtataatgaaaacagccatccgtaaattgcgggtggctgttttttctgggcatgctacttattctgcagcgcttctgccagttcatacaatgaatcatactgcttaatttgatagccccgcccctctttttgcaaataccctttttggcagaattgcgtcagcacatgcaagagatgacggtaagatacacccaaataatcacagaccgttacgtgcttctctttataaacccctttataagccgtctgcaaaataaaatcagcaagccggttttcaagcgggaacgccagactttgtgaatatttcgaagccataagcgttgccttagcacttaaaaacttagccagctcacgcaggaatttcgcatcctgcagcaattgcacgcggcagcggtaaataggcagaacaaaacaaacagtcttcgctgaggcttgaattccttttgtgtaatacacttcatgtaatagttccatctctccgatgtaatcatttttgttgataaaattaattaaagaaactttcccgttttggtgggttacatatattttcgcttttccttcaatcacgtaaaacaggaagtctggcctcctgccctcttgaataatccattcgtcccgctcatattcgcgcacttccataaactcttcagcggggaaagagaataaatgcgcgattgagtgtttttctaactgatgccgctttttctcgcctttataaatttccatcgtccaccccaaaaatatgagatatctcatattgtctttatgtccttacatgataacatgccaattaaaggaggaacgggaatgaaagcatatcgctggatgagtctgcatttttttagtttttttatgacatggggtgtttttctgccctattggacgggatggatggtgcatataaaaggggtttccgtatccgaagccagtttcattatgagtctgggcctggcggcaagagggatttccacattatttttcttcccttatttatcaggaaaattcagcagcaaagccttattaaacggcgccagaatcgggacgcttctcgcacttttatgttatattccggctgattcttttcaaagcctgcttcttgtcacattagtgctgcatgtgttttacccggctttaatgcctgctttagacagcgcttgcggcgtccttgtacagcataacgaattaaaggcttatgggactagccgacagtggggatccgcgggttttgtttcagccggcgtcatcctgtccgtctttacaggtatattcggagatcaagcgattttatgggcactgcttttgggcgccctgatattcgcatccctaagctttatgcatgcgccagctgttctttcaaaacggccggaaacagaccgtgcaagaaaagagggcatgtttgccttattccgcatcaaatatttcggtctggtgctcgcaatcgttatcttactgcaggcggcacatgcatcttactacaattacggttatctctttttgcaggaaatcgatgcgcccgcatatgccatcggaatcatcatcaacatcgccgttatcacggagattatcttctttgcaatcgctgaccgatactttcatcaatttacggcaggctctttgctcgccctggcggcgcttggtgctaccgtacgctggatactcgtatttgcctttccgcatgtcatcattttctgtcttgcgcagacgctgcatgcctgttcattcgcgatgggacactatgcatttatgaaatacttaattaaaaatatttcacccgcgcaaatcccgaaagcccaaggtatatattcagcgcttgctctcagctggagcactgcggtatttactattttcggaggttttttatatgaaattgaaccccggtatgcctttatcggaatgattgtttgtacgataccgtccatgcttctcgcccttttatacagaaaacttgaaatgaaaaagagcgtttttgcaggaaacgcacaagatatatagccatcgctttatagacgatcacatgtcccgctgtcattttgaccgattttgtgaatgctgtgcgatgtattttctctatatttaaagtatttccttcatatatgatgaaattaatgaagggaattcgttcagaaacttggacagaatcagtgaatataatgatacagtactgcttacgctcatttgggggaactttgttcgcaataaaatgattttcagccaactcataaggagggacattgtgtcacagcctaatatgcccaatatcacccctgtcgttacactttccagagacgataccattaaccttcttctttcgtcaattgctatggaagagctgggaatggcacatattctgaatgcggaaggggaaaaaatccaatacgcgctcggaacgattcccggattaacaggacccccgtcaagtcttgcggatattcttaacctgaatgagagcgtccgggatacgcttgacagcttaatgaaacaggagctccttctcggttcaaaattggacagtatctcaaatatccctacattggcgggaccgacgggggccacggggccgacgggggccacgggtgcgggtcttcaagggattgttgcttttaatccgctgatcgcccctacttacacgaccggacaggttgtcttgtataacggcagctcttatgtcgcaaacgtaaacagcccgtcgggaacccctgaaacctcagctgactatacacttttagctgcggcgggaagcaccggcgctactggttcaaccgggcggaccggaattaccggggctactggcggcactggatcaactggaattaccggcgttacaggaccgaccggagttaccggggctaccggcattacagggcctccgggaagcaccggaacaagtctgacagccacttccggctatgcgagcaatacgggcggcggtgttgtcgcagttattaacggcggcacggccatttccttaccgaatgaacaaaacctctcagcggatattaccgctaatgccgcaaatactgtattcaccgttgctccggcaggacggtactatatttcctaccatattaatttaacggccggcctgctagtaagttcgcgcatcttaatcaacggcactccggctgcaagttcgattattgctccggtcgcgtctttggcaaacttcaataactcctttattgtgactttgacagcaggcagcaccattcagctccagctgttcggattattgggtgcggccacattgcttagaggaagtgccggcgcagctttaaacattattcgattatcttaatggaacatgcaaaaaaaggatcaggcgtttgtccgctgatccttttttaattgagacagaagttcttgcgcgggtttaaattgcggattgaatttcacggattttttggcgtaagcgatggccgtcatatcatggtttaatgcagcatggcatttcgccatataataaaaagctctgaaatcggcggcaccttttaaaatgaagtgatcagcgttttctccttcaacctgcgttccggcttcaaatgctttgattgccgctctgtacttttccaaatgatataatacaaggcctttataataatgaagattgctgtaatcaggataaagcttgagcactttttcaatcccttgttcggcttcttcatatcgcttgagctcaagcaatattgtatattttagaaaatacagaagagacggaggcattcgtttctcacttaaaaattgaaatattgagccgttgacaagatgtaatgctttttcatagtcttttattctgtaacattcacttgccagatgatagactagccacggatcaggattttcctctgaaagttcttcatttaatatgctgatattccgtttatgtttttgtttgattttttcttcctgctccaagtagccgtagtgatgaatcacacatgggagcgtgaaaaaagcattgttttcttcctcattgggagccgagatattctcgtgaattctgccttgatacagaaggcctttatgattgcggaacagcctcggctgcatgctttcaaacgcttcgttttcatcgagctgcttccccgtataattgatgattttcaaaagtccccggctcggtaatccgtcatgaagcagagaagttaaaaaacggcccgtctcctgatcgagctcttcatccgcgtcaagcactaaaatccaatccccttcggcatgctgcagggcgtaatttctggcctttgcgaaatcattctcccattcgaaatcaaacactcttgcctgaaagcttttacatatatcttttgtattatcttgtgatccggtgtctgcgatgacgatctcatcagcgatgtcttgtacacttgataaacaacgggagatatatctctcctcgtttttcacaatcatgcaaagagtcagtttacattcagcatttccgctcattttctcacctttcccgattttggagttgttgattgaaccaaggccgtccaggagtgccgttcatcgttatgatgacaggccgcacccatctgacggcaggttcggcagttgattctgcatcccattcctgaagctgcctgacagcccgcttcgtaatgggatgcgcccggaattcgcgcgggctttcacaaatgaattttttcgttcgttccgtcactgtcttcatttcatgaaagtgccgcgcatacatctgcttctgttcttcttccaagctgatcattaaaaacagccggccgcccgtttccatctgccagcggcacaatgcggagaacagcctgatttcttctttgtaatttgaaccccttcttttatccacggtcacagataatatatttaacagcgccatcgtgagacaatgcaaggcttcaaaagatgtctgtttcgcttttgagatgctcggatacggcatatgcttcacccgtctctttttttatgaacgctccccgccttttttcttccaatcgcagtcctcacaatccccgcactcacagcagccaatacggccgtaaaacaggtcgtcacacggatcttccggatcactgggatcgtccggattccacgggtcatcaggatcgcccggatcactcggattacttgggtcgtccggattccacgggtcatcaggatcaccgggatcactcggattacttgggtcgtccggattccacgggtcatcaggatcgcctggatcactcggattacttggatcgtccgggtctatacaggcttcagcatcctgtaagtagataatgtcttcaagcttcgtctgcaaaaggagttgtgatttcatgacggtgcgcaggagccgttcagtgcttctattgattgatgataattcccctaaggagggatcgccggaagcgctgagaaacatttgaatcctttccgcttccgcctgcagaatatgggatagtccgatttcttccatagccacggatgaaagaaggaggttcagggtctcacatctggagagtgtaatgtcgggggtgatgttcggtatgtttggaagagtcatcgatttctccctcttttctcttggtgtcattatgcaaaagtgctatatcgtattcttattccgggagagaagagatcattactgatgttttcgttaataaaatatcccggatatgaaatccgggatattcgttcgtttctttatttcaattcaagtttgacgtctacatttcctcttgttgcttttgaatacggacagaactcgtgagcggcgtgcaccagcttctccgccgtttctttatcaagatcttttgtatcaatgacgagcgttacgccgattttgtaacccccgtcactctcatcttttaaaaggctgacctgtccttcaatttcagaggtcatgtcgattttttgtttttgggcggcgagttcaagcgctcccccgaagcaggcagcatatcctgccgcaaagagctgttcagggtttgtgccggtttctccgtctttttttgcattcggcatgatgatgtcaaaatccagcaccccgtcttcggatttaatatgtcctgctcgtccgccgactgcggtcgcttttgaagtaaataatgccattattatcagcctcctcattgtacttactgtatatattgcccctgctcatatttttaaacatgattgcaataggaaatgggccgtttttcggctacaataggggtaacgttaacaaaaaagagttggtgaaagaatggcagaaaaagattttgaacatatgaaactggagaatcagctttgttttttgctgtacgcaagctcaagggaaatgacgaaacggtacaaaccgctgcttgataagctcaacgtaacttatccccagtatttggcgctgcttttattatgggagcacgaagaactgaatgtgaaacggatgggtgagcttttgcacctggattccggaacgctgacaccgatgctgaaacggatggagcagcacggaatcatcatgagaaagcggtcggctgaagacgagcgatccgtgacgatcaggctcacagatgaaggacgggccttgcagaatacagcggcagatatccccattgccatgctggaacagacgggactgtcaaaagaggaattaaagcaggtaaaacagtcgctttatgaggttttgaaaacgctgcacggcaaaaaataaggatgccccgaatgggcatccttatttttattctgctgccagaagcttcacttcaatatttcccgctgtcgcttttgaatacgggcacacaccgtgcgctttttggataagggcttcaagctcctgtttctcaatgccggatgctttgacctcaagggtaacgccgagtttatatccttggtcgctttcatctttcagcagactgacatgcgcagtgacctctgtttcaatactcagacgctcttttcttgctacgagttgaagagcgctgtcaaagcaggctgaatatcctgcggcaaacagctgttcagggtttgtggcttgttcgagcttttttgctcttggcgttcccggcatggcaacatcaagattcagcaccccgtcagaagacgtgactttcccttcacgtccgcctgcggctgaaacggttgcagtaaataatggttttgtcatataaattcacctctattatattgtgtacaatttaattttacgaaatataatggaaaccgtcaatctttccgcataaaaaaagcttaccctttttgaaggataagcttaaaagattatacccggatttgtccgtttcctttgatgatgatttttgtagatgttaacgccggaagtcccatcggccctctcgcgtgaagcttttgcgtgctgatgccgatctcggctccgtatccgaattcaaaaccgtccgtaaaccgggttgaagcattatgatacacggcggcggcgtcaacggcggtctggaagtaagccgcatgctcggcgttctccgtcagaatggcttctgaatggtttgtgccgtactgctgaatgtggcggaccgcctcctgtacgtcctgcaccgtttttacactgagaataggcgccaggtactccgctccccaatcggcttcttctgcttgtttcgcttgaggctccagtccgcaaatcacctggtctcctcggagctccacccctttttctgtcagctgattcagcagctttcgtccgtgttcttcggcccatttttcatgaatcagaagagattcaatcgcattgcagaccgaaggacgctgtgttttggcgttgatgacgacctcgcttgccataaggggatctgctgactcatctatgtacacgtggcaattgcccgctccggtttctaaaacgggtacggttgattccctgaccacaagatcaattaaatttttaccgccgcgcgggatcaatacatccagcccatcatttaatgtaaagagctgtttggcggtttctttgcttgtatcttcgatgagctgaacggcatcaatcggaagctttgacagcccaagtgcgcgtttcatcacactgacaagcgctatgttgctgtggatggcggaagaacttcctctgagcacaaccgcgtttccggttttcagacagagtgtggccgcgtctacggtaacgttcggtctggcctcatagatcatgcccactactccgaggggcacgcggatcttttcaattgataatccattctcttttttaatggtctccaatgattcaccgacgggatcttcaagaccgattagcagttccacggcgtccgcgatatcgagcaggcgtttttcatcaagcgtcagcctgtcaataatgtcaggtgtcaatcctctgttccgtcccgcttcaatatctttctgattctctgttaaaatcagctgccgttcatttctgagtccgtctgcaatacattggagcgcttcgtttttttcagccgtcgttttcatgaccatttcggcagccgcttcttttgccaaagccgctttttgcaatacttcactcatttgtgttcccccttgtcaaataaattcacccaatcatctctgtgaatcacttccacctgcttcgttcctgaaagctggtcgctccgcttccctttggcttctaaaatttcatcggatgagtactgtgtctgccctttgccgataatgccgccgggccctctgacttccactacggctcctttcggaaaactgccgcagacatcggcgacgccggccgggaggagacttgacccgttatggatcatcgcctgctccgctcccccatcaatgatgatttcccctgatatcggagaatgaaacatgatccattgccgtgtattattcactgaggacaggtctttatcgccgatataagtgccgtcgccttttccgtttaaaatcaccatcagtttttcacgtccggagccggttccgataaacaccttcaccccgagcgacaatgcggtctgggcggcgagaagttttgacttcatgcctccggtgccgacctttgagcctgctgacccggcatatccgagcaattcaggtgtgatgtcattcagatagtcaaaccgctttgcgtccgggttttcattcggattggcatcgtacagcccgttaatgtctgtgagaatcattaattggtctgcatgaatcaaaccgcttacaagcgccgacagcatgtcgttatcaccgaacgtcagctcttcgactgatgtggaatcattctcattaataatcggcacgacgccgcgctccaacagttccattacagtggcataggcatttctgtaccgctctctttttgagaaatcatttcttgttaataaaatttgtgccggcgtcagaccgtatccttttaaatggtccatatattgctgcattaaaagcgtctggccgactgcggcagctgcctgttttccttttatcgtaacgggtcgcgacggatagccgagagcggaaaaacccgctgccaccgcgcctgaggtaatgaggatcacttcatgcccgttttcttttaataaagaaatggcttccgtatgttccttgatttttgcttcatcaatacttccgttactgttggtgagcgagctgctcccgattttcacaacaattctttgttttttcatcgtttctcctccgtggcaatcaatccaaaccggctctcgtcaataaaaaaagcccattccgtcctgaaaaataaggacgaaatgggctttccgtggtaccaccttgtttgaacgcgtttttcacgcgtcccgctttcctgtaacgccaggtatcgcgcctgagttttcccctcaggactccaaggcaggttcggcaggtttcatgcggcaaaatgtttcagcgggccattttgctctctgtcacagaaagttctgcgtactgatcctcttcaacgctcaatgatttttttatattatgcaaagaaaacaggttcttgtcaagacattttcatccataaaaaacagcccgcctccccggcggaccgtcattaattaaatacgatcgttttgtttccgtgaacgatgacacggtcttccagatgccattttacggctcttgccaacacgctccgctcaatcgttctgccgatattcttcagatcctctgcgtgatctctgtgatcgacgcgttcaatatcctgttcaataatcggcccttcgtcaagatcgtccgtcacatagtgagaggtcgcgccgattaatttcactccgcgctcataagcccgtttatacggattagcgccgataaaggccggcagaaatgaatggtggatgttaataatccgattcggatgggcagatacaaaatcagacgtcaaaatctgcatgtagcgggcaagaacgatcacatcaatcttatactgctccagcagctcaagctggcgccgctcaacttcggcgcggatatctttgttagctttcatgtaatggaatggaatattcagcggctcgaccacttctttcgcctcttcatggttgctgatgacgaccgcaatttcggccatcatattgccgctttgccattcccaaatcagttcatgaaggcagtgcagctctttggatacaaagatcgccactcgcttcagctcacttgccagagagaggctccatgtcatgccgaatgtctgggcgattgaggcgaacgcctgctgtaaatcctcttttttctcacgaatgcccttgcagtcgaattcgatcctgagaaaaaaacgtccgccttcagggtcagtcgtatattgatttgattcaataatatttgcgccgtgttcaaacaaaaacgcggaaacagccgatacaattcccggctgatcggggcagctgacaagcaggcgccctttttcctcattaccgcggcggtattctttcagccgctgtgtcatatatgaattcatctgttttaatccctcgtatcttcataattcgtaacttattatagattatactgaaaatttgataaaaatcaatttacgaaagaattttcagccctacggctgcgcacaaaataagcgcaatgaaaaagatgcgcttcgcatccttctgctcgccgtagaaaagaatgccggctagtgcgccgcccgccgtgccgataccggtccagatcgcataggccgtgcccatcgcaatcgtctccatcgcataagaaagcagggaaaaagaagccgcaaatccgacgataatgaaaaaaatccacttgactttcttttctttttgaaattgattcattaaaatgaccccgagcatttcacaaagacccgcggctatcaggctgatccaatgcattacgccttctcctccttcgtctcaggcttatcctgtgtgaccagctttaatccgatgacaccgatcagcaaaacgccgatcagcacgatttttaccggatcggcctgttctttgaaaagcaggatttcactgagcacggtgcccgctgtcccgagtccggtaaagaccgcatataccgttcctacgggcaggctgtccgtcgccttgattaatagataaaaactgatgatgattcccgtaatcgtgccgccccacgtcagtgccgaatcagcatgtttcaggccggtgacccataccacttcaaatacggccgctatgaccactaaaccccatttcatgttcttcatcctttctgtttccgggcaatacaaaaagcccggaatagtcgtctcacatgagattgactctcccgggcttttttccctccgtgtgcatatgcgggatatgtccgcatatgtgttttctctcggaccaggccatgtatgaacatgcggaaccctagaaaacatgtctgttcgtatcatactacatttcgccgaaacgttcaacgtcagatgtgatgtcaaataccgtcagccgcctctcccatttggtaacggtctcaccgggcaccatgccgattttttccgcgacgcggacggaggcagcattttccggatcaatcagcgccgctatgcgtccgtattgctgcgtatgaaaaccgtagtccagacaggcgttcgccgcctctgtcgcatagccgcagccccagcggcagcgggcaaacatatagccgatttccatcaaagtgtttccgcttatcgtctgcggaacgattccgcattgaccgagaaatgcacccgacactttatcctctgcgatccaaagactgacgccgtatcctgcggccaatcgtttgttccaggcaatccattccttcgtttcccgtctgcttttaagagaaggataatatttcatgacctctctgtcggtaaacagcccgtacaaattgtcttcatcgtcatcccgcatagtccgcagacggatacgcccggttgtcaggatggtgccggaagacttatgtttcatcatgcacgccacgtctcctttccctgtaataaattatggacccggcaggaaaagtcctttttcagcataaaaaaaccgcttttaaaaaaagcggtttgacgattaccaaggtttatctgttccgagcgcctcggccagggccttgctgtgttttaagcggttttttcgttctccggcgcgctgaacggccgtattgtgaagcatgatttcttcctcggtttccggcacgatccgcggaacgggcaccgatttcccgtttgaatcgagcgcgacgaatgtcagaaacgacgttgccgcaagctcgcgttcacccgtcatcagatgttctttaatgactttgacaaacacctccatagacgatgtgccgacccatgtgacgtaggattcaagacatacggaatcctgttggccgatcgggcgcaaaaaatccacagaatccattgaggccgtgactgtttcacaccggcagtggcgggccgcggaaattgaagcgatatcatcaatatagctcatcagctttccgccaaacagcgtattgtgattattcgtatcaagcggaaaaaccctgcttgtcttgacaacccttgtttctttgcaaaatcttgattctggcaacttcatattatttaaactcccctttggtgtctggtcgttttgacatttcatctgtaccctattaaacaatactttgatcgttttgtctaaaattttaaatattaagttggttagatattctatcagaaatgtttcattatttatcacatccgggaataataaacgcacattgaataccgataggaggatatcacatggacgtatccatacccaaatccacgcggaaaccggcttgccgcagtgagtttgatgctttgcagacagtcatcttatgccggccggaacacatgaccatcaaggatattattaacggaacgcagaaacatttcaaacaagaaaatattaacatacccgttgccctcaaacagcatagtgagtttattgacattttaagatctcatcagattgaagtcgtcctgctgcctgccgatcccgctttgcctgagcaggtattcacccgggatatcggatttgtcttaggcgagacagcgtttatttcaaacatggcggcttcagtccggcagggagaagaaaaagtgtttcaagacctgcttgacgataagaaaatcccttatacgcgactgaaaaaagcgaacattgaaggcggcgacatcttgatcgcagacggcaccgtttacgccgggctgagcaagcgtacggataaagcggctgtccgggagctgcgggaggcgctgccggagatgactgttgtgccgatccctctcaaggaggatttcttacatttggactgtgtatttaatatgatctcggaaacggaagcgctatactgtaaaaatggcttgcggcagaaagaaattgatcttctcgccgaacgttttgagatgatagaagtgcctgaagaagagcaattcacgctcggcccgaatatcctgtcaatcggcaatcagacaattatcagcctgccgcagcaccgtcatacgaaccgcgagctcagaaaaaggggttatacggtcattgaaaccgagttttccgaaattatcaaatcaggcggttccttccgctgctgcaccttgccgcttgccagaacatcttaaacatttacaaggcagtttccttcaagatacgttaatatagagaagacaagactctaaagggggaaaccgaatggctaagtacataggatacgcgggaacatatacaaaaggcggaagcgaaggcatttattgttttgaacttgatacagaagcgaaaaggctcagccggccgaagctggcagcaaagctcggcaacccgacatacgtcactccgaattctgataacagcatgctgtattccattgaaaaagcagacggaaaaggcggcgtcgcagcctatcagattcatcagaacagcggggaattaacgtttgtaaaccaccagctgattgaaggcccgtctccatgccacgtcagcattgatgataaacatgaatatgtgttaaccgctaattaccacagcggaaaagtgcacgcctttcccgtcaatgaggacggaagtctgcaggagccggctgccgaagccgctcatacgggaacaggtcctcatgaaagacaagagaaaccgcatacccatttcgctggctatacacctgagcataactacattgcagccgtcgatttagggacggatacgctgtatacgtaccaaatgaaaaacggttcgctcacagaggtgaaaactcactctttcgcaccgggttcagggccgcgccacatcgttttccatccggcggaaaaatacgcctatgtcatgacggaaatcagcaatgaagtcatcgcgcttgaatacaacccgaccttaggtgaattcagagagctgcaggtcatttccgctttgcctgaaggctttacggacaaatcgcaaggcagcgcaatccgcatatctaaagacggcagatttctttatgccgccaaccgcggacatgacagcatcgccatctttaagatcaaccaatattccggtgaattgtctcttattgaatgggtgccgacagaaggcaactggccgcgtgatttcgcgtttgacccttccgagacattccttgtcgcgtcaaacgaagaaacgggaaatctggttttgtttgaacgtgatccggaaacaggcaaattgactctgcttcaatccgacattccggttccgtatccggtctgcgtgtcatttctgcatcagatttaatcaaaaagaaagctgactttatattgtcagctttcttttttgtataaatggcaggcgacaaaacgccccgccttcacttcttcaagctcaggcgttatcttaccgcagagctccatcgcttcagggcaccgcgtcctgaatacacagccgctcggcgggttaagggggctcggcagctcccctttcagaataatccgttcacgcttgtcctcaagaagcggatcaggaatcgggattgaggataaaagcgccttcgtataagggtgaagcggttcccggtaaagcgcagcgctttctgtaatttccatcatgcggcccaaatacatcacgccgatccggtcgctgatatgcttgaccattgataaatcgtgggcgataaataaaaatgtcagccctttctctttctgaagcctttttaataggttgacgacctgagcctgtaccgacacatccagcgcggaaatcggctcatccgccacgataaattcgggatgcagagagagcgctctggcaatcccgattctttgcctctgtccgccgctgaattcgtggggataccggctgccgaaatccggatggagcccgacagcttcaagcagttcatccgccatcatcatacgggcttttcttgtattgtaaagattgtggatttccatcggctccataataatttcccttacggtcagacgcggatttaacgaggcgtaagggtcttggaaaatcatctgcagcttgcggaagaagaccgaccgctgttcggccgcggcacggtgtatatccgtcccttcatatgataccgaaccggccgtcgggtcatacagacggagaataactcttccgagcgtcgatttaccgcatcccgattctccgacaagtccgaatgtttcccctcttttaatgtgaaagctgacaccgtcgactgcttttacggctttctttcttcctgcgtcaaaatgcattttcagcccgctgacttcaaggagcggagatgccgtcattttctattcccccttttcgcttatacagcggcgtacggtgcataattctttttcatagatcgttccttccaaggacagcacttcgattgtttttcccgttttcggggagtgcagcattcggccgtctcccagcgccaaaccgacatggtgaatcgcgccttttccttcttcataggcgaaaaacaaaaggtcagccggccggatatcgtttaccgccgcgccgcacccggcttttgcttggtcctttgcatcacggggaagggtatagccgtttgctttaaatatcgaatacataaacccggaacagtcaaacccgaaaccgctcagtcctccccataagtacggaagcccgagaaacatcatgcccgtttcgatgacctcggccgcccgtccttccgtatgccggcactcgtctgcgtcagcttcatttacgaaccgttctccgagaggcgtcacaacccgaaaaaagcctttctcacgtcctgatgccggaagacgcgttaagaaacttacttccaagtccggttcgccgttagtgtgatataaaaaagctgtcggtttggtaatccatacggcgggcgaagatgaaaaaaagccgtcttttgaaagctggcttttttttatccagcccggatatccgcgcgcatccttgtttgagggctggccgggaacggcgacaaaagcccattccccttcctctttgagaatgatcacctcttccccgaaaagcgcttgcgtttggacaaggttgtctgtgcataattgcagccgctcttcatatcccatagacgctaaccattttctgatctgcggcgggttttcaagcatcggcgcatcatacgaacggggagatgacggcatcgtccatacgttggctgccgccgctgtaacggctgctctcatcttttcgcctcctcttgtttcgacaccccggtaatgccgagacccggttcatcgggaatcgtaatctgactgccgctgtatgtgatgccgcctttaatcaaatcatctttcagcataagcggcgcatcaaaatcaaaccttgtcacattccgtttgcccgcggcaaaatgagccgcggcggtgatgccgagcttggtctcaatcatgctgccgaccatgcattccacgccgcacgtttcggccatcgcattgattgtttccgcctgctttatgccgcccgctttcatcagcttaatattgattaaatcggcgcttctcgtctgcagcacgcaaaaggcctgacggggagtaaagacgctctcatccgccataatcggcgtgtctacggcatcggtgacctgcttcagcccggcgatatcgtctttatgaacaggctgctcgaccagctcaatgccgaggccggcgtcttccatctttcggatcgcagtcacggcttctttcggcgtccagccttggttggcgtccaatctcagtttgacgtttccgccgacacgtgatctgatcgcctgaatccgggcaacatcgtccgatatgtcacctatgccgacttttatctttaaaatatgaaatcctttgttcacatagcggtctgcatcccccgccatctcctcaggagaattgacgctgacggtaaaatctgtttccagtgtattccgatagcctccgagaagccggtaaagcggctgtccgtgcatttgcgcccatccgtcatatacagccatatccaccgcggcttttgcgctttgatttctttccaacagccggctgatatcatacaaaacagcttctatgccggaaaggctccgccccaagagagcgggcttcagcacatcgcggacggcgctttcaataccgtccgtgctgtcgcctgtaatgacaaccgtcggcggcgcctcgccccagccggtcagaccgttgtcaaatgtgagcttcacaatgaccgattcagcattgtaaaccgtgcgcaaagcggtcttaaacggctttttcagcggcacggacatccgtcccgtttgaatatctgtaatcctcacgcctgatcactcccttccggaaacccccgattcaatcgttaccgctttggccgccgtatccataaccgcgcgggctccgatcggaacggcgaagctcggtgaacaatggccgattttaaagcctttgagcgcgggcttccctgatttgacaatgtaatcgttcagcacttgctctaaagtaagcgacttttctttatgcttcggttcgcattggtgaaaatcacagaccagtattccggctgcgtctgacagttttccggccatctttaattgattcagcatcctgtcgatttgatacggctcctcatcaatatcctcgataaacagcaatttgtctttcgtatcaatttcaaacggcgtgccgagtgtggacgtaatgagcgacagattgccgcccgcaagctctccctcggcccttccgcctgtcagcacctccagcggagaaatgtcctccgtataggtgaattccgtttctgtaaaaagctgatgatacgacgcttttgtcaggggttcagcatcttcaagcccgacatccgtgctcagcatcgggccgtgaaatgtgacgagccccgtattttgatgaatggcggtatgtaaaaacgtaatatcgctgtatccccagaaaattttcggattgcggcggattaagccgaaatcgatgtcggcggcaatgcggcccgtgccgaatcctccgcacgcgcatatcaccgctttgacattctgatcactaaacatgtcatggagatcattgaggcgcgcccggtcttctcccgccaaatagccgtgacgggtcttcagcgcccggccgagtttcacttgaaggccaagctcattctctaaaaacagcagcgcggtttgcagcgtcccgctctcaggcgggcttgcgggtgcaatcacaccgaccgtgtcgcctttttgcagtgctttcggtttatggttcatgactttttcaatctcctttccggattgaaaagtgaaacacgccgctcctttaacggcaaaagagcggcatatgtttccgctgtaagatcaggacttttccgcccatttcagatcaatgtaaccgacggggtgccggacaatgcccttcacgccgctgttctgcagatgcacctgattgtaaaagtaaatcggaatgatcggagcctcgttcatgagcagcttttccgctttatgcatgagcgcaaaacgttttttggcatcggcttcctgttttgcctgcttgatgcagccgtcgtatgccgcgcttccccagccggtgcggttcatggaattatccgtttggaaagcctcaagaaaactgatcggatctgcgtaatccggtaaaaatgagctttgagagaactggaacttcagtcctttctgctcttctaaaaagacgttccattccatattggcgagcttaacgtctataccgagcacacttttgagcttctgctgaatcgcttccgctattttcttatgctccggttttgtgctgtatgtcaatgtaacggcgggcagcttgtcataatgctcttctgccatgcctttttccagcagttttttggcttctgattcatccggagttagtaaactgccgcccgcttcgcggaaatctttcccgtcaggctgagtaaatcccggggatacaaaggcatgtgccggcttttcactgtttttggtcacataatccgtgatttctttctgatcaatcgctgccgcgaacgcttttctgatcttttcattttgaaacggctccattttaacgttaaaacgatagaaatagagtccggcctgatcccacgtgcggacattttttcctcccatcagctgctcgctcagctctgccggcacaaaggcggtatccaaatcccccgactggaacatctgatagtcggtattccggtcactgaccatcgcccatgtcactttatccagtttcaccgtctttttatcccaatacgtctcgtttttgaccatcgtcatgctgtcgtcatgcttccattccgtcagtttgaacggcccgttgccgacaaaagtttttgcttcagtgaaccatttcgcatcagccttggcgaccttctcattaatcgggaaatacgccggattggacacgacgctcaaaaaataatcctgcggggccgccaatgtgacgacaagcgtttttttatcctttgccgtgactttcacgtcttcttttttgccttttccgctgttaaattcttctccgcctttgatcatatagccgagaaaagcggaagatgcgcccgttttcggatcgagcatccgcttccaggcgtacacgaagtcttccgccgtgacgggatcgccatttgtccattcggcgttatctcggatattgaaggtatatgtcagcttatcagcggacaccttccagctttccgccatggccggttcgggcttattatcttttccgagcctcgtcaatccttccatgatgttattcagcggctgccaggaaacattattaaatccgatcggcggatcaagtgaggtcggctcattttcgttattgagccgcagcaccgtctctcccccctgttcttttgctttgccgggttctgtccccgcctgttcattggctgtacagcccatcagagcaaacgaaacaacagcaatcacaccaatcgcccatctctttttcatttcaatccccctttttcctctgctgcagtcagctgctgcttcagccgctctgcacggtgatcctgaagccagcagctgacgatacggcttttggatttcacggttgttgccgggtataccttttcacagacgatcatcctgtccgggcagcgggcggcaaacgggcagcccggcggcggatcgaataaatcaggcggcgtcccgtcaatcggcgaaagctcactatcttccatatccagccgcggcactgaacgaagcagcccctttgtgtatggatgagccggacggtaaaaaatatcatgcctcgtgccgatttcggcgattttccccgcatacataacggcgactctgtcggcggtctgagcgacgacgccgagatcgtgggtgatcagaataatagacacgcctgtttttctttgaatcttcttaaataattcaaggatttgtgcttgaattgtcacatcaagagccgttgtcggttcatcggcgatcataatttccggctcgcagatcagagccatcgcgatcacgatccgctgccgcatgcccccgcttaattggtgggggtactgcttcaggcgggatttcgagtccgggataccgaccagatccagcatggcgagaacctcggattcagcttgttttcttgtcatggcgcggtgttccaacagcgcttctgagagctgatcccctatggtcaaagtcggattgagcgccgtcatcgggtcctgaaaaatcatagaaatatcgctcccccggattccccgcatttcccgatccgacattcggcaaaggtctttctgtttaaattgtatgcttccggattcaatctttgccgaatgtttcggaagaagacccatcacggcttgtgacgtcacgctttttccgcatcccgattcaccgacgatcgcaaacgtttcacctttatataaatcgaagctgacgcctcttacggcttttacagtgcctccgtatgttgaaaaagtaacatgcagattttgaacggaaagaacttgctgcgccatttttcctacctcctcagtttcgggtctaacgcgtcctgcaagccgtctccaagcacgttaaacgcgtacatcgttaaggaaatgaaaaaagcgggaaaaaacagccgccaccaatggcctgataaaatcgccggcagcccgtcatttgccatgactccccagcttgcaaacggcgcctgaatgccgagtccgagaaaacttaaaaatgattccgcaaaaatcgccgccggcaccgtcagcgtcatttggacaataatggctcccatcgtattcggcagcagatttttcttaatgatccgaaatgttttcgctccaaacgttttcgatgccaatacgtgttcatcatgcttcatcctcagcacctgccctctcacaatccgcgccatgccgacccatcccgtcactgtcagagcgacgataatggaactgagccccggccccatcagcaccattaacaaaatgacaacgagcagataaggcaaaccgtagagaacctcgatgattctcatcatggcgctgtctgtccggccccctttgtagcccgcgacgcctccgtagataacgccgatcaaaaagtcgatcagcgccgccatcacaccgacaaataaagagatcctcgctccgtaccacgttcttgtaaacacgtcccggccaagttcatcggttccgaaccagtgtgaaaaagaaggcggaagattctgctcggcgagcgtctgccttgtcacgctgtgcggtgatatcagcgggccgaacacagccgatagaaacaggcagcataatatcacaagtccggccatcgccaatttgttctttttaagccgccgccacgcatcctgactgtaagacaggctcggacgcttgaccgactcggtttcaccctttctttccgcgcccggctgaaaccagtcatcaggcacttctgtgtgttttaccgtttcttgcgggagattcatcaggatcaccctttcttatgaagttttatgcgcgggtctaacaggccgtatgccaaatcaaccagaaacagcaggacgatcagaatcacactgtaaaatacggtcgttcccatgatgaccgggtaatcgcgctgattgatgctttctacgaaatatttgcccattcccggtatggcaaaaattttctcgatgacgaaactgcccgttaaaatacttgcggcaagcgtcccgagtactgtcacaacaggcataagtgcgtttttcaatgcgtgtttgatcacaattttgacgggagaaagcccctttgcttttgccgtgcggatgtaatcctgagtcagcacttcggccatgcttgatcttgtcagccgcgcgataatggccatgggaccgacggcaagcgcaacagtcggcagaaccatgtgaacgggactcgtccaggtagctgccggaaaccatttcagatgaaccgcaaattgctgaatcagcagcgtagccattataaaattcggaatggaaatcccgagcaccgcaaggctcatggccgcataatcgagaaagccgccgcgcctgagagcggccgttatgccgagcgcgagtccggaaatcacagcgatgatgatcgccgttatcccaagctcgaaggagacgggaaatccgcgttcaagcatggcgtttacactgtctgacggttttttgattgaaggaccgaaatcaaaggtaagaatggattttagatagatggcgtattgagtgataagaggttcgttcagatggtagtaggattcaagatttcgctggaccgcttcgtttgtgccccgctcttcgttaaaaggcgagccgggtatcactttcatcatgacaaatgtcagagtggtgatgacgaggacggtcataatcatggcgataaaacgtttgataaaataccgcagcaatgccgttcacccctttaacagaatgttgttctcatagcgagttctgtcatgacgagcatggcctgataggcttccggcatgtcttttgcctgaaattgaacgattgtcgttcccgggatgatttctgtgcccggcattaaatgggcccattcagcctgtccgtaattggcaaattcaatgcctaatacaggtttttcaggcggagtcagcggtttgaccttatctttatttttgagcgcataggctgttttttccgtcaggagccgtccggctttttgaggggacaggcatttgaccgcggttcttgaaatggtttgtttgacggcggcagtcgtcacattcgggatcagctcctccgcctcttttgcggcgcaatcatctccggcagccatgatgaccgggacatcgtaaaatccggcgagataggcatttaaccccagttcaccgacaggcttatcatttatgtaaaagtggcggacgccgaatatcatgctgtgcgacatgacgcccggcatcgacgctctcgcatgatagccgataaacatcacacctgaatacgattcatcaagcccctgcatcatggaaaacggcttgacatcccccgtaatcagctctgcctcagggtgaagtttttccgcgagcagattattcatctttgagtggctgtcattcacggtcacttccgtgcatccgttattaaacgcttctgcgatgcaccagtttgcttcttcggtcatcagaaccctgccgcgctcataattgtgcatgctggaattgacaaatgtttcatcaggcagtccggaaatcccttccatatccacagatagatacagtttcatgtaatgcctccttttttatttaaaatttcgatattaaattatgaatattctaacaaattatattaaaaaaggatgaaacatgcaatataccattctgccattatgggaaaaaacaaacccttttcaccgggaaaagggtttgctgatagaaaaagttacataccgtttttgtttatagggtgaccccgaaactgtctgaccgcacttctgtattcgcgatcgggaatgacctgatgcctgatcggtccaggagcctgcggcgaaggcttttcatccgcctgcttacggacggcatgcggtttatgcgccagcttatgtcccatgccggtcgcattcatgacaaatgataaacacactaaaagcaagcttaagatgaaagcaataagaaacaaatcgctgtatgtccccatcagcaggtcatgcggcgattgtgtgccgcgcgcgccccgaagcatgccggaagcatctcttttcgtaaaataccctattaaaacaggtgcgcccatataaatgaacagccttaaaaactgaacggccgtcatgcgtttcaccagttccggaagcggtccgcccaacgcggcgcccatcagtccggctgctacgataagccctgtcccggccgccagcatcacgaaaagcgccgcaaatagaataaacggtatatgatgacccgccgtcatccattggaaattcacgaacaccagtataacagagcctgttatgccgagcatgcccggaccgactttatcatatgctaatgcactgataacagcggcgatggccacgcctcccaaaaggctcgcatataagaatatcagttgagtttgtgacatgtgatatgcggtctgaagctccccgtgaaatgcagaaagactgaccgctatggaaatactgcccgcagcgatcatgaaaacacccaaaatcggctttggaatcagcataagtttaatcgaaatcagcgcatgttcgtttctgtactgcataatcagcaggatcagcagaatgacgatgcttcctccaaatcccgccaatgtctgccatgatgaaaagccccatttcggcagatgaataaaagtataggcggtcagcacggctgatccacccgctaacagaaaaccgatgccgtcaaatggagatttttcagtatttttatgagcgtcatcccgcagccacatataactgaaaatgaggccgaaaaaagacagcaggccaaaaatgccgaacagccaatgccaatggccggcgcttgccgccgccgtgcctaaaacggtccccataatgacggacccgtaaaatccgccgattaacacaaataaggcgtaattccggcgttcaatcggaaacgaaagcaccagcatcggaatcataatcatcagcatagtgcccgccgcagctccctgtaaaaaacggcccgcggcgagcggataaatatcatttgtcacagcagcaagcagcgctccgatgacacccgcggccatcgaaatcatatagacaggccgggagccgaatctttttcttaaatacggccccgccggcacgaataaggcaaatgccatattaccgataataatcggatgaaaagagtcaaagttttccccgccgaccgtctgccggacaaggctttggacagccgaaagagcggtattcgacatcagccccggcccgacagccagcacagcaagcagagaaatgatccagtgatgtttttctttcatttgacagctcctttcttaactatttgacaaagtgaaaaagctaacagatttcccccattagcttgacagaattttttatatcttttcatgtgaaggattgaacataatatcccatttattatttcaaatccgatggaaattgtcaatataaagcgccgccgtccgatttcgtctttttcacaatttcccacaatcttttcattattatcccacactttttgtttaagatggagtcagtaataataggcaaatcatgctatgatgaaatagagaaacggagtgaacatgatggataactatcgtgatgaaaatcggacagaccaaaaagaacaggaagtccttttagtaaaagaaaacccgcagccggccggatattccgagccggacgaggacaagaaaaaacgaagcttcggctggttcagaccgcttctcggcggagtgatcggcggagggctcgccctcggcatctatacatttacgccgcttggagaccatcagactcaagatacttccaatccggctcccgctcaggaaacgtcatcggtaaccgccaagcagacatcttttgaatcagacagcggcaaatcggcaaacagctcatcggcaaattcaagcagcatttcgaatatggtggaagacatttcaccggcgatcgtcggaatcaccaatctgcagaagcagcaaagcagttccgatttattcggattcggatcaagctcggattcaaactctaatgcatcgggtgatgatgcggaaacgggatcgggttcaggcgttatttttaagaaagcaaacggcaaagcgtatatcattacgaataaccacgtggtcgaaggcgcctcttcccttaaagtgtcattatatgacggcaccgatgtaacagctaaactcgtcggccgtgattcgctgacggacttggccgtattagaaatcagtgataaacacgtaacaaaaacggcaagcttcggcagttcatccgctctcagaacgggtgaatccgtcatcgccatcggtgatccgctcggaaaagacctttcccgcaccgtcacacagggcatcgtgagcggcttaaacagaaccgtctcgatctctacgtcagccggtgagtcaagcatcaacgtcatccaaaccgatgccgccatcaatcccggaaacagcggcggaccgctcttgaatacagaaggcaaaatcatcggcatcaacagcatgaaaatcagtgaaaatgatgtagaaggcatcggctttgcgattccgagcaacgatgtaaaaccgattgccgaagagcttctcacgaaaggacaggtggagcgcccttatatcggcgtgagcatgatcgacttggaacaagtgccgcaaaactatcaggaaggcacactcggcctcttcggcaaacagctgaataaaggcgtttatattcgtgaagtggcgcagggatcacctgcagccaaagccggattaaaagcagaagacatcattatcagcttaaaagggaaagaaactgacacgggcagcgaacttcgcaatattctctacaaaaatacgaaagtcggcagcaccgttgacgtgaaaattatcagaaatggcaaggaaatgacgaaaaaaatgaaactgactcaaaaagaagaaacatcttcttaacaaaaatccaaggcagccgccttggattttttatatacagatgaaactttaggcctggatcagccgtatgactcagtgtacaaaggaggatacatacacatgaaacaaaccggacttttgctggtcgttaccggcctgatcttgctgcagctgagcattcagcttcctcagcaaaacgctgcttggggaatgacgcttggtgcaagcattttactgaaatttttcgtgaaccggactgatcatgcgctctctgcacacccagaccggccgcagatgaataaaaaaagccgcgggacattctgtcatcccgcggcttttattttacataaaagcaccctgtccgctggccggacagggtgtttgttaagacatatgctggtcccgataaatcttttcgtttttcataccgtacgctttttgcacgatatagagcggacgatcttttgcttcgtcataaattcttccgatatattcgccgatcattccgagcattaatagaacgatgccgctgaataacagctgtatcacaatcagagaggaccagcccgtaatggtgctgtctgtaaaaagcttcatgtataaaacgataaacatatagagaaaacccgctccggacatgagcattcccgcatagcttgccgccttgagcggtttatgagagaacgttgtgatcccgtccatggaaagcttcagcatttttttaagcgggtatttcgtttcccccgcaagccgctcatctcgttcatattctacagcagtctgcttaaagccgacccagctgacgagtcctctgacaaaaggatttttttcttttaatcttttcatctcatcacagacttttctgtccagcaggcggaaatccccggtgtcgagcggaatatcaatatcagtcacgctccgcagcagccggtaaaacagagaagccgtctgtttcttgaaaaaggtttctccctttcgtttcgttctgacggcgtacaccacatcgtagccttctttccactgctcaatcatatcaaggattaattcaggagggtcctgcaaatcggcgtcaatgacggcgattgcattcccctctgcataatccatacccgctgtgatcgcgatctgatgtccgaagtttctggaaaaatcaataattttcactctcggatcaatcagactttgctctcttaaaatctcaatactgcggtctttgctcccatcattgacaaagatcaattcataatgctcttttgtttgatccatgacttctttcaggcgctgataggttgtctgaatgacgagttcctcgttataaaccgggacgactattgaatattgaatatgtctgctcatgttttttcctcctattcatcagattgaagttcgtatagtgaagctgactgattcattccgcccggcccgccgctcattcggctgtttttacccgcggccttgctgctttttgtatcagctgcatcatgatttttcgttttctgatctgtgcttgattgccatttgtatgaagatactttctttccggttttctcaacccattcaacaatatcgttgtttccgcctttgcccattccggatgttaagaagtattttactttcccttcttttacgagctttttaaattgagtcagcgtaatggccgggtcagacccgctgaatccgccgatcgccatgaccgcttttttcgtttttataatgtaaggcgccgctgtgttggaatcggttgcagcaaatagataatccgctccggcgttatgtttctctaaatagttgatcagttttgtattgacagatgcgttatccattcccatgccttttccgcctgctgacgcaagctgagggcctgtttcaggcaatgagctgttgcctccgtacagaagcggtgtgctcgcccaataaatcggcatcaccatcaagacgagaagggctgcaagtgaaacatagtaactgagcggtttttggcgctgtttgaatacgaacagggcgattgccgccactgcaccgagaacgcctgctccgatgctccagcctgcgccgatttgatcattgtagtttttaaggataaacagctcaaatccggtagtcacaagaatagcggccggcaatagccaagttttccatcccgcctgcttgcggtacagatgaacgagggcgacccatcccgcaccggtaagagcagcaatcggaggcgccagcataatgagataataatggtggaaaaattccgccacactgaagaatccggcaatcggcacaagccacgctgcccaaaagatcgtttccttctgttctgctgataatcttcttctttctctcgccccggcgatcaataaaccggccaatccaaaaatcgcaaacggcaggagccagctgatctgatcagataattcttgttggaagagtctcagcggaccgggtgttcccgtaccgaacattcctgaccctgactgcattttcgagccggtgcctgtaccgctttttcctccgccaggaccgcctttgccgccgtctccgccgcttggagggcctccttgaccgccgcttggcatttgtccgttagatggaggtgccgtcatactgccggtttgtgatttgtctccgcttgctgactggccggccggtttttgcatttgtgaagaaccgccggaagaagacatccctttcgatgcgtttccgtcgggcccgccctggccgccgccggaactttgccccgtcagccgctgaatcccgttatatccgaaagccaattccaatacggagtttgtctggctgcttccgacatatggccttttgccggcaggaatattgtcaacaatgagcggccatgacaatgaaacggctgctaatacggccagcgcgcttaccagtgaaatgatttttttcttaatcgcggtatttgccgccatcatatagaacagcaagaaggccggtaagatcatataagcctgaagcatttttgtgttaaagcctactccgacgacaaaaaatgccgccaaaagccagatcagttttccttttcgaatcgctttaaagagaagccatgtggcgaacaagaggaaaaagaccagtaaagcatcgacattgtttgtgcgcgctacggctacagcaatcggtgtacacgccatgacaaacgaagcgatgcgcgccgccgtttttccgaacgtcggctttattaataagtacatgaatagaactgaacctacccccgccaatgcctgaggcaggatgacactccacccgtgcataccgaatatcagcgcgctgatcgtttgaatctggtatgtaacaggcggtttatctaccgtgataaatccggctgcgtcaaatgaagcgtaaaagaaattatgaaagctttgaagcatactcgttaccgctgcggtgtaataaggattcaccgtatcgtcattccagatgttgtacatattcaagaatgcggaagcgagtaaaataaggattaagactgcgtctatctcgcgttttttcattttcacctgtgttttcactccttttgtttaactttgaacaagtgtaacaaccaaatgtgaaaaatttattaataaacaaagacatttattttgccgtttacaaataggtaaaaagaatgacaaaacgggtaaaaaagcaaaaaaaaagatgcccccgtcaagccggaaggcatctttcattacttctgatttactgaatcggtttcagccgcgcttctatttcagaacggcggtgttcgagataaggcgggagcgcaaccgttttgcctagctcttcaggtttttcatcaaccataaatcccggaccgtccgttgacaattcaaacagaattccgttcggttcccggaagtacagcgctttgaaataataacgctctacaatgcctgagttgctgaaaccttctttcgtaatgatgcggtgccataaagcaagctcctcctcattctgaacacggaaggccacatggtgcacgctgccttttccaggacgctcgcgcggaagatcgtttctttcaatgagatggacttctgtacgcgcgccaccgtttccggattcgagcaccgtaaccgcgccccggtcttcatgtgtttctttcccgatttcagtgaagcccagcacatcggttaacacacgcagcgtcggttctgcatacgggacggtcaattcaacgggcccaagaccgcggaaagaatattcttccggtatgccgctttgcttcaccgcttcaccgatgtcttttcctttttcgtcagctgtcagcacaagccgctgtccttcatgatcctgaaaagcgagtgtgtccctgcccgctattttcacgatctcaccgtgagagacctgatgctcttcaaatcgttttttccaatattgaagcgcttgtgcatccggaacacgcaggccgattgaagaaatactgtttgtccccgcatggaacggcgcgatccgcggaatctcgaaaaacgtcaattccgatcccggattggctgattcatcaccgtaaaataagtgatacatcgtcggttcatcctggtttaccgattttttcacaagcttcagccccaggatatttcgataaaaatctaaatttttctgcgcatcagccgtcaatgctgatacatggtgtattccattaactttcattatgttatcctccagtcaattatctcgatttcgagatattttatatatacaatttatgttatccggatcgtaaagtcaacccatctgcttcacagacggtctgcagactgccgctctcaaaataacgaacttttgatattaaaaaaccattaatgttcgcttttaaaacagtattttttccttctcaaaagcataaacctttatcttttaggcaaaacaccaaaatcagaaaatttattttattcgtgtttcagcaattagggtttacaatatggaaaatagttttttcagcataacgattttacatctggagggaaaggatatgcagattgaagagaatggacttaaaaaagagatcggccttaccatcgccctctcacttgttatcggcaccatcatcggttccggcgtatttatgaaaccaggcgccgtgcttgcctactccggtgatgcgaaaaccgcgcttatcgcgtggctgttaggaggcattttgacgcttgccggcggcttgaccgttgcggaaatcggcactcagattccgaaaacgggcggactttatacatatctggaagaagtgtacggcgaattttggggctttttgtgcggatgggttcaaattatcatttacggccccgccattatcggagcaatcggcttgtatttcggctctttgatggcgcacttgttcaattgggattccggctggtctaaattaatcgggatttcagccgttttatttttaagcatcattaacattatcggaacgaaatatggcggcatcgtacagggaattacgactgtcggcaaattgattccgattatctgcatgatcgtgttcggcctttggaaaggcgatcagcatattttcacagccgtcacaagcagcatgtcggaaatgaatttcggcgccgccatactggccaccttgtttgcttatgacggatggattctgcttgcggcactcggcggcgaaatgaaaaatccggaaaagctgctcccaagagcgatgacgggcggactcttggtcgtcaccgccatttatcttttcattaactttgcgctgctgcacattcttcctgcgaccgacatcgtcaaactcggtgaaaatgcgaccggcaccgctgccggaatgctgtttggcgacatcgggggaaaattgatcagcgtcggaatcatcgtcagcatcttcggctgtttaaacggaaagattctcgcttttccgcgtgtctcgtttgcgatggcggaacggaaacagctgccgtttgccggacagatttcgcgggtgcatccgacattccgcaccccgtggattgccgtgtcatttcagatcgcgctggccattattttcatgatcgccagcaatcccgataagctgtctgagatctctattttcatgatttatattttttacgtcatggcttttttcgccgtgtttatcctcagaaaaaaaagcggcggaaaaccgcgcgcctacagcgtgcctttgtatccgatcattcctgttttggccatcgcgggttcactgtttgtgctgatcagcacgatcattacagatacactgagctgcgcgctgtccctcttgatcggcctcgccgggctgccgctttatttttggctgaaaaacggcagaaaaaactgacaaaaacggttccttttacgggagccgttttttttctggcaaaatcacgtgcaaaagttgacagcaaattcacatcttttgttatactttttaagcaagatgtctgaattcgaagtatgttacgtttttttggcgaagtgggtaacataagaaaaacaggatgagacacgtttttacgaaaaaatcaagaggcgtttttttcgactttatctgttttttttcgacaaaaggctatataataatttgatgtgtgcattgtctcattcaaacaatggagggtttttaatgataaaaagaaaaaaagataagttctcactccttttaacagaaatcgcaaaaaacatagacgaaaccgcagaatactttgtcaactttaaagtgacgaaccagacgactttaaaggaatttgccgatacgttaaaagagtttgaaacaaaaggagataatcatgttcatgtcatgattaaagagctgaacaaagcttttatcactcccattgaacgtgaagacatccttgagctgacaaacagcctcgatgacgtgcttgacggaatcgaacatttttcagcaatgatggagattttctcgatcacttcttcagatgagcatatcgataagttcagcggatacatcagagagtgcgcgaaggaaattttaatcacgattgagctgcttgcagaaaaccgattgaaggacattcaccctcacgccattaaaattaaggaatacgagcacagctgtgataacctgcaccgtaaatcattaaaaaatctgttcggcacagaaaccgatccgattaaagtgattcagtaccgcgagatttacgaaacgcttgaggaaattgccgactcttgccaaagcgttgccaataaccttgaaaccattattatgaaaaacgcgtaacgaggggttataatggatactctattacttttaacgatattaattgtcatatgcgctttggtatttgacttcattaacggatttcacgataccgcaaacgcaatcgccacctcagtttcgacaaaagcgctgaagccgcggcacgcaatcgtcatggccgccatcatgaactttctcggagcgatgacatttaccggtgtggcgaaaaccattacgaaggacattgtgaatccttatacattagacaacgggtcagttgtcattctggcggctctactcgccgcaatcgcctggaacttgatcacatggtatttcggcattccgagcagctcttcacatgcgattatcggagcgatcgccggagcggccattgcagcgtcaggttttgcgacgcttaattataaagggttcattaagattatcgaagcacttattttatcgccgattatcgcctttgttctcggctttatcgtatattcgatcgtgaagctgatttttaaagacagcaatctggcgaaaacaaataaacgcttccgcagagtgcagattttgacggctgccattcaatcctatacacacggaacaaacgacgcgcaaaaagcgatgggtatcattacgatggcgcttatgacggccaatttacataaaagtgatgccattcctttttgggtgcagctctcttgcgccctggcaatgggtctcggcacatccatcggcggctggaaaatcattaaaaccgtcggcggaaaaattatgaaaatccgtccggtaaacggcgtatctgccgacttaaccggcgcagccattattttcggggccacgtttattcatctccctgtcagcacgacgcacgtcatttcgtcttccattctcggtgtgggcgcttcccaccgcgtaaaaggcgtaaactggggaacggctaaacggatgcttattacatgggtcatcaccctgccgattgcaggtacactcggcgccatcgcctttttcatcttagatctctttttctgatgacatccgcttctttacagaagcggttttttttgtgacaggaaaatgatgtcatgacatagaatgaacatagcagaccatttttcgaattgtgagggatgctcatgcttttgttttttcagatcatggtgtggacgatggcggccgcactcattttatatgtgtacgcatcctggcggtatgaagcaaaggtaaaagaaaaaatgtttgccatccgtaaaacgtggtatttactatttgtagtaggcgccatggtctattggacatatgatcccgaatcgctctttgccgcatggagacaatatttgattgttgccgtctgctttgcccttattgatgcgtttatctttttgagcgcgtatatcaaaaagctcgccggcaatgaattagagacggatacgcgggaaattttagaagaaaataacgaaatgcttcactcctatcttgaaaaactgaaaacctatcaatatctgttgaaaaatgaaccgatccatgtatattatggaagtacagaagcttatgcggaaggcatcagcagactgctggccgcttatggagaaaaaatgaatgtcacggcttccttgtgcgactattccgcacaatcggataaggaccgcttgacggagcatatgcctgatgcggcggacgttcagtcccgtcttaaccgtaaagacgtctactatgatcaaaaaggcaggcttgtgcttattccgtttacagtccaggaccgccattacgtgatcaaactcacgtcggaaaacctgttgacggaattcgattatttgcttttcacatcgctaacgagcatttatgatttaatgctgccaatagaagaggaaggtgacggttaaatggagcaggcatttcaaaacgggcagccggaacaaagagcgaaaccgttcaaaatgtttaaaaaacgttcaatgacaagtatcgcaagttaccaggtcagccctcataccgccagaattttcaaagaaaacgagcggctgattgacaagtataaacaaaaaaaagcttgattacactaaggacaggagacacggctcttgtccttattccttttttccatatctttcatataataaaaccaacaaagagatgcgacaggtgatgatgtgaagaaaattgtcagacgcgtaaagtttgtggattacggacgcttcgggctttccgcttattcgctgaggatgcgggcgaggaatctcgggttattgaaccggttaaaaaagaaaaaaggctgaatcccgcaatgtgaacgggactcagctttttttgttaaagctgcatcagaattttcgcttttacagcgggaccgtagacgccgtcagacgtcagtccgtttacagattggaagcgggccacggcatctgccgttttcggaccgtagataccgtcaatgccgttattgacagctcctttttcaggatagaaataaagcgcggcgagcgcgttctgcacctggtataccttttcaccggacgtgtacggctctgtcagcttgatcacctcgtccggaagagaatacagtgcttcaaccggcgggctgacgatcagcacttgtccgactttaatcaagttcgggtcagcgatgttattccatttctgcagatcggccacgctgacgccgaatttccgcgcgatcgccgacagtgtatctcctttttggacggtatacgtctgtctttcctcagaaccgattcccgctttaaactcatcccatgtatccagcagtcttctcggacaaagctttcctgaccaatgcttgtgcgcaacgacattcgcaagcgggatgccgtgcgacgtcattaatgtgcggatgagccattgggcgtttgccacggcctgtgaaaagttgccgtctgcgttttcacaaatttcaataccgatggatttacggttgccgtccccgtttccgtcaccggcatgccagccgttttcgttcagcggaagatgctgataaatttccgtatcatcgactgtgaaatgccagcttgtcggtgtatcgggatttttcacatagcttgcgtgacttttggcgttagctccgactgcggtattggctgtattgtgcaccgtaatgtaaatcggtgtcattgcatagcctgggcggttattgtttcctgccgggataaaatcctgtgtgatttttaccatattctcatctctcctatttcgataaattgtttatttttaataaagcctgctgttttttcccttttgctgtaacataattgtttttaaaccaggcggcggcagtcgttatgattgtaaaaacggccgacccggcggcatacagcgtatctgcaagctggctgacctggtcctcctgaatattcagcggcgatttgccgaacatcagcaaagtttgattcaataaagcaagcaaaagaagcaccgtcctgacgaccgtgcctttgtccgcgaatttcatatcggtttcccccttacttttgcagcagattgtacatgatggcgattgctccgccaatgacgcccgtgcagattgctgtcacgatcgctcctgtaatggtccgcttaatccatgttgtgttttcgtcaattttgttcagtttttcattcagcgtcatgatttgctgatcctgccggtctgatacccgctctaatgcggctacccgctgttcaagcaccttttgttcacctttgatgtctgcgaattctttttgcaccgcttgttcatccagaagcacttccgctccctcctcttacattgttctcacctcccttcggaagcttcattcttaagaaaatgccgtgcctttgacagaaaggctcccgccggaaatgctcttgatttccatgacgatttccttaaagccggcaatatcaaatgaccacacttcttctgtgcctgacgtaccggcggctgatgtcccgtcatcagacctgattcctctgatcggcacattttttcccgagatggatctcccccaaaacgcgacatggcccgactcagccgtaccggtgatttcgacgagaagttttttccaagcgcctgctgagaagatgcttccctcgcccgcctctgctgcattttcatgaaaaatcacgtctgtatatgaaaacgccatatcaccgcccgtaccgacagattggtataaaacaaattcggactgcttttgatttccattttcaaaacggaaccggtaatatctttttgtcaggctgacccaccccgaagcggtcagcactccgccttttactgcgacaaaatgtgaagctgtccacgaattgttatcctcgctctcttcgataaaaagagttccgctgcggtccgaataagcccacccctgtgctctgtctattaagacggctcctaaacggtcttgtccgaattggctgtagacttcaatcgcttctagcggcgtattggtaagaagctctgccattccggacaaatcagcaaccggtgtgacataatcgtttttgttaccgcgataagcttttacggcgccgggcctgccaagttgatcggcgggaaattcaaatgaatgctttttcatcggccgtcctcctgttctcatttattaaaaatgacaaataaaaaaagccgtttggcttatgacacagcatttttatagttttcgtatgtttcacccgttatttcttgaaattcctcaggcgtgatatacttcgcggccaccccttcagccagatcttcggcagagcagtcatcatagcccatagcctgttttaccatttctgttgaggcccactcataaaacaaggcgtaaacccaaaagttaagttttttcatttttttcattctccttttacgtttaagagttccagttttaaagacgctaattgcctgccgagtgactgctgcgcttgttcggctgcttttctggccaatttctcattcgccagctgtccgccgaggcctgcaagctggtttgaatcgggagccgtatctttttttaagctctctttatatgcttcgtcagcggtttccacccattcttgtttctcttcatcaaaaaatgggcgccacatgccttcgccgtttatttccggcggaaagcccgcagcgttaggcggcatcacataatctcctgtctcagaatccggataaagctcaaccggagtgcctgtataaatgttgtcattgtcatacggaaatattaatttcatattctcgctcctttacgtgagtgccaaaacaaggtcaatataatagccgttcacgttattttctatattggccataattcccgtcagcttcatatctccattagaatagataataaatttgctgtaaccggtggtgccgctggctgcaaccatcgttacaacgcctttggccggcgcacaagaggatggcacactcccgaataccacttctctgtccgtaagaacgtgtccgttcaggtgaagggtgtttcccactttacggtattgaagcggcctgtctcctgatttagcgccatttttataaggaacatttatccaaggtacattctcagtatcaagttcagtaacgaggcgacgccagccctgccagcccaagttcaaatccaaatagttcgtgaacatattatttttataatcgacggcaatgacatacccaaacgttcctttcccctcactgtcaagagaggtaaaatgaaacatgccgcgggttgaagcgttgctcggactgtttgccgctttgccggttgaataaaaggtgccgaacgccctgccgtttttaacgattttttcaagaaagttatcatcatcaccaattgtcagaagatagccgccgttatcgtttgttattttcgaaagctgtgcgccgttccacatatctttatccgcctgtgtgacatgaatgtcttttttattggcgtgagcctctacttttgcttgagagcctgaatctgtttcttgttggctccattccgaccatacgcctttagtgctgaaacttcggacgtatatgggatttccggcggtcactgtgtctataaacatttggacaaaagtcggtgatgctccgcgggttctttgcatgacaattaattgtccgtattccgcaggcttattttctgtatgctgaactgatatatagtagatgccggacgtttttatattgtctaagtttgtttctgttaccgttttagcattcccgtcattgtcagtcagattgaataactgccctgcattccatttgtctttgtcagacttggttacatgaagatctgttttgtcggcatgctcatttacttttgcttgtgctccggcagctgtttcaaatggcatccattccgtccagatgccgtttttcagcgtttttctccaaaatcccccgtcatctgagaaagcggccgcctctccgttattctttgaagaataaaggtatataccctctgacggtttaggcggggtatttattccggttgcagctgctgagaaagtaaaggtcttattctggctggcagcggtctgatgaaaatcctgtccgtcagagatattaataaaagcggagccatcatcttttgtgattttagacaattgcccgttattccacttctggcgctcttctttcgtcacatgccggtccagatcttgattgtgccggtcaaaatctttctttgctgcctgctggacattgtccacgtttccgaggccgatttgcgcctttgtcgttttgtgcgggttgttcatgtcgtttttatgggccgccagatccgtgtgggcgttttttatgcctttttcccagcggttgacgtcatcttcattaatcggatcgtccggaagccagtctgttttttcttcgtaagccatcgttacaccacctcaaaggtaaatcttaaatcaagcgttctgttattgctgagatctaaatttgtttttcgttctgtaatgacgcttcctgtttcgtcaagcatctgcacggtttcaatgtgtttgacgtcttcttccctgcgtgtgagaacggtgactgcggcatcttttacggaaatgtccgcaatcggagtttctttgccgtttaacagcacttttgtgatcctgtttttcagatcggctgcggcacgctgtctgtaagcggctgatatcatggtaagaccacctcgttattgttgagtgtgacggaataaccgaccttcagttcactgacttttcggtatctccgattgttgagaatgacccggtctttgatttccagtgtttcgtttaatgcggctctcagtgtatacgccaaatgagcgggtttgattttttcaagcgtttcaatcagctcgttcatgtgctgcaggtcatcaagcccgatatcggcataaaaacgatactgccccggaaacatccgaacataagctgacggatgttttaaaaaacggtttagcgcctgctcgatcgcttgatgtgtgatgggcggaatattcgacatcttcgagatcagcctgagccgtctcatatcctccgtgtcacctgattcccgcggtatttttaatattttttcccagcggtcaagcccccatgtcgccgtcgtgataaagagctgatccgtcaaatcgaaaatatcgttattctgccgctcaaactcaggagcttccgccataagcagttgtgccatctcttttaatcgggttaaaaacggcgggaggtacgccgtcatctcatcgagtctgctcaaggattttcacctctttgagtttaggaatttccacgtcactgagcacgaggttttctgccgcaccgttcattttaatatcggcgtagtcactgacggatgccgagttataaacgatgttgttaatttgtgataaacggacggtgttttcttcaaaggccattttcttgaataaattcagtacgcctttttcaatctccgcttttacgtcatcgatcgagctgttcagctcaggcagcacggaagcggagatttcgatttccttccatactgcgctttccaccgttactgccgctccgatcggcgcctgtccttctccctgcccttcgtccggatcaatataatcctttacttttttgatcagaatatctgatgccggttccaaattcgcatttgtgatgacaactttcaccgttccgtctccgttccaaagcgggaagatttttgccctgccgacgccgtcaatctcttcggcccattgtttataatgctgtttatttgcgctgactgcctcccggcggacacgggtaaaatagcgcgcccttaagctgttgtcatcttcttcctcacggccgggaattaatatatcgcgcatgactgctttctcaagcccgggtatcgtatcaagcggcagcaggttctgccccgaaatgccggcattgcccgcttcaccggctgtttcacattcaagcgttccatcccccgtatattgaaaatacaggttatcaacgaagaaacgggagcctggcggaatggtgatgcccgctgtgaattctccggctctgaccgctttagtggcaggtgttcgttcaattcccgcctcagcagcacgcctgtccagaaattcaccctgagccgtatcggaaaacacgagctccagcacggtatccagccaaatataagactttgcgagctcagcggccgcaggcgcgagcgcattgtaaatgacgctgccttctctcgtatcaatatccgccgtaacgcgcgccagcattctgtccataatgtcgtcaaacgtctgagcttcaaacatcctcacccagcacctcctctatctcaagcatgccctcatcagtttcaacggtaaaagagacgatgaaggcatcatcttttttctcaatctcaaaattggtaacggccaaaatacggtcatcatacagcaaggcttcttctatcagtcttggaatctccatttttttataagcatccgtcgtgttctgatctgaaagcacttcctgaagttcgtttccgatatcatggctgaaaaccgaatatgaataccgttctgtgtgaagagcgatatagacgaattgtctgattgcgtccagtccgtttatcagttcattggtaatccggttgttttcaaagtcaattcggtaggtttgtgaagtctcaacagcctcactcgcatcctccaaatcttcaaattcgatttccggtgtcagggccattgcacccgctccttttagatttgttcatgtaaaaaagccctcttcggcagatgaagcggctttaataggctgatattcccgtatatctccgtccggatgccggttaaattttgtccagtacaaagaaagactgtcctcctgttaaagcggcggtcatcacccgatctcccgcctggagctgatcatcttctccggatctcagccgcttcggcacaatgagtgcatcagacggaatcaaaagtttgtcgtgatctttcagtttcagctcgagcggcgaaacggaggtcacttcggccggcatcagctccaccggcgcttcagcgtcaaccgctccgacggctaaatgtttaatggcatcacttaatctcatcaggctgtcccctccggaagtgaatttttctccgtgacgtcaatcgtcatggtatgttttgttccttggaattcatggcggtccgtatctacataataggttttcttcagcccgatttccggaattgaaatatagacgggcaatccgctttccaacccaggaataccgatcgcctgtatatttttcagctctttcttaatgccttttttctcagcctgcttcacttttgcgcgctgtttcagctgggcttcgttaatgtcgtcagaaaccgtttcggtatactgcaaaacgccgaatgttttcatgccggcgctgtctgaggcggaagcctttatcgttttattgtctttttgcagccgcatgacgacacgggttgcggtgtcatcaattgaggtgctgtattgataccctgtaatattaactcctgtttccagcacccatatgtcagacggctccggccattcacgcaagccgagcctgcctttttctgaatagagctgataattgcgccccgtctggctttttgtctgctttaacgcttttagcatcatatcgtaaaggcttgtatcatttttaaaaacgagtgatttaatagtatggcctgtgttggcaatggatgtgacgggaatttgaaaatcgctggcgatcctttttaatatttgatcagcgcgcttgttggaaaacacgtaaacgtcctggtttttcacaaggtattggagcatatcgtatgcggtgaaggcgacggtatgctcatcgggcgttcttgcaaaaacaatgccgcggaacagctcttttccgttccatttgaacaaaaccgtatccccttctgatacgccgtaatacgtctggctgccctgctttacgacaatcgtcgcttcgatggagcggggcgcctgatatctgtgtccttccagcgttacgctttctgtgacaagctcgagccactccgtttcttttatgacaaatagttcaatcatcttttcacccgtttcattgcggtatcttcagcttctgccccgggaagatccaatgccccggctgccggatattccgtttgctgcgcttaatcatggcggttttattcgcgttccagattttccgccactccgtgtgttttccgtaaaacttgccggcgatgtcccaaagcgtatccccttttttgacggtatatgttttgggtgaagctttggacgggcgcttcgctttcgtttttttcttttgtttgatttttcttggcgaagcggttttatattctttcagtacgatatcaaaattccggtcgccgatttcattgtcaccttcgctgtaattaaagctttcaatgctgcatgtgacattgatttttgtccctgtaatcaaaaactgaacgggttttttcgctttcatccatgcttcaatggctgaaatggctttttccggtgaaggaatgctttgatattcggcaatcgggctgtaccgtttcggaaaaaaagaagagaacgaaatttctttcgctcccggttcttcgataaacgtcacctctccaagtccggtgactttcacggaatcattctgcacgctgtttgcgatatcaatcgcttcagggagaacgggaagccggagcttgtccttcccttgagacagccaaaattcgtaaacagatttagtcaaaagcaacggccccctttgctccggtataaatgtctttttgcagttcatcaatcagcgcctgtttgattttggcggctaggctctcggcgtcctgcccgttatggaaatgctgatcgccgctgaattcgattttaatttcttttgttcccgttttttgaacggtttggccgccgcctttaacggctgcggaaaccgtgccggctgaaagcgccgccggttccgtccgggacggatcggacacttccatgccgagcgcctgagccgctttttgcagcagataacggccgcggatgccccgctcttcagggatgatccactcccgtttgttcccttcgccgacacgggcgatctgctccttggtaatcagacccccattggcataaccgacgtaagggccgccatgagccatacttttaatcccggggacattgctgatcgagccgtatcggcttttaatatagccgatagcggcagcggcgttgtggattggatttctgatatcattcatgcccggcgctttgtgatcttcaaaggtgctcggaatcgtctgcataagcccctgtgacgggtgtccggctttggcgttgctgtcccatagattaatggaattagggttgccgcctgactcatgctgtgcgatcgtcattaatcccggaagccagctgatcggcgtattggttgctttcattgcggccaaaagccattctttgacgcttcctcccgctgcacccatgccggaaaaggctgctgcaagcgagcctgcctgtttttccgcatattttttcacgtcaactgagctgagacctttgacgacgccgactgaagcaaagcgtccgagactcatcatgacacgggaaggagagtgaatatcaagctcttccctgaatgcgtcctcgacttttttggccatatctttggccgcctgtttgacttcgcttccttttgcagtcatccctgatacgaagtgtccgatcaggcctgacccccagccgttcgcggaatctcttgattgaacaaacggtttattgatatgtgtgcttacgtattgcgacgttcccgtatcttttgcattctgtccggccgaataacctttcactgtggcggcgccccatgatgacgattgattaacctccgattgataaggtgttttcacctttgtttttaaaaacgaatcggtgcccgtcggcgatgtattctgacctttggcatagcccgcagcgacttgctttccgtaatcgggcgaagacgaaataagggcgttaaacggcgttccgatgtttttctctttccagccgtccatatccaccgctttattgctgattccgctgtcaaagccttcagtaaactgtttgccgagtgatgaagccgtccccgcaaatccggaagcatccacagacgcagcggccgatacagacgccgaagaagaaacaccgcccgctcccgccggcacagcggaagactgagccgaagccgcgcccatatcatcgacaacacgcatgccgagcttagacgcagcttgtgaaagcagcatcttcccgcggccgcgattgttgtcgacggggatgacaaattctttaccggcttcaccgatccaggaaatggtcggctttgtaatgtagccgcccgtggcgtttttgtccgtttttttctttttatctccgccgcctcctgtgacaaagtccattacgcctgaaatcaatttgccgccggttttatcccaaatctttttcacccagtcgaatgctgcagaaaaagcatctgatatggctgttcccacttttacaagaggttcttttatatgtttctcaaaccagccgcttaaccctttccatatatcctttaccgtatctaaagcagtcgtgaaagcgtctgatattccttttccgactttttccaccatgtttttcaccgggttccagacaatatccatgaaccagccggataccgtactgaaaacagatttaattttatcccaagctcctgtgattttactccaaatggacgtcgctactccgacgacagccgattttacgggctcccagacagtgctcataaaccagccggatactgtgctgaagacaccttgaatcgtcgtccacgcattcacgatatttgaccatatgcttgtcgccactccggcgacagctgatgaaaccggcgtccatacattctccatgaaccaggatgacaccgtgctgaaaatcccttgaatcgtcgtccatgcattcacgatatttgaccagatgcttgtcgccactccggcgacagctgatgaaaccggcgtccatacattttccatgaaccaggatgaaacgcttccccaagtatcttgtactgttgtccaagcactttgcgccgcttcggaaatatcattccatgtgtctttcaaagcccctgaatcaaaggcctctcccaagctggaaccgcctaaactgccggcgatgccgcctaccgcgccgccgattaatgtgcccactccgggaacaacgctgccgattgccgctccggccgcggctcctgcaagaccgccgcctgctgagccgaccttctctcctgcattatctttattgatgccggctaaatcagtaagtgataacaattcacctatgccgggaattcctttagcggcaccttttaaccctttcataccgcctttcagcgcctttgaatctcctaagcctttcaaaagcccgccgatgcctttacctgccccttttgttttcggcgtgtttacggatgcctgtttgctttcctttacggaggaacctcttttcgaagatttattccgcccttcgactttactgcttttgcccctcgtcactccggtacagcagcagccgccccccaaagccccgccggtttttttggctgaccttcctgaagatttcggtgatggtcccgtgcgctgcggaccctttgtcagctcaggacgcttcgggctgttggtgccgccggcagaaaggctccccttactcttttcttttttcgtgccgcctcctaataatccgccgatattgagtttgcctaatttttcagcgattcctgaaaatattttttctattaattccccggctttttcgatgattttgtccgggctgaatttctcaaatttcttggcaatcttgctgacaattttatcaacaaatgcctcggctttttcgatgatcgcatcagggctgaacttgccgaactttttatcaatgcctccgaacagtgaggaagtaaactgctccactttttccagaatcttatccggattgagaaaatcgaatttctcagaaattcggtcaatcgtgtcatttacaaattgttcggcgcggtcgattagcttatcaggactgaatttaccgacaacgtcgtcgactttcttcataaacgaatcagtaaaatgatccagctctttcaatatggtctccggactgaatttgctgacaacgtcatcaacctttttcataaatgaatcagtgaatttatccagttctttcaatatggcttccggactgaatttactcacgaccccgtctacctttttcataaacgaatcagcgaatttgtccagctcggctaatatcgttgccgggctgaatttgctcgcgatttcgtccgcttttcccatgaataaggtcgtgaacttatccagctctgctaatatcgtctccgggctgaatttgcttgcaatctcgtccgctttccccatgaatgaggtcgtgaacttatccagctctgctaatatcgtctccgggctgaatttgcttgcaatctcgtccgcttttcccatgaatgacgtcgtgaacttgtccagttcggctaatatcgttgccgggctgaatttgctcgcaatctcgtccgctttccccatgaatgacgtcgtgaacttgtccagttcggctaatatcgttgccgggctgaatttgctcgcaatctcgtccgcttttcccatgaatgaggtcgtgaacttatccagctctgctaatatcgtctccgggctgaatttgcttgcaatctcgtccacttttcccatgaatgacgtcgtgaacttgtccagttcggctaatatcgttgccgggctgaatttgcttgcgatttcatccgctttccccatgaatgaggttgtgaacttgtccagctcggctaatatcgttgccgggctgaatttgcttgcgatttcatccgctttccccatgaatgaggtcgtgaacttgtccagctcggctaatatcgttgccgggctgaatttgcttgcgatttcatccactttccccatgaatgaggtcgtgaacttatccagctctgctaatattgtctccgggctgaatttgctcgcgatttcgtccgctttcttcataaagcttgcagcgaatttatccagttccgctatgattgtttccggataaaatttggatgcgatatcattgacttttttcatgaaggtgtctgcaatggagtcaagcattgaaaaatcatttttcggcgaagcaggagcagcagatgcagaagcttttccgacgtccggcatattcttttgcattgcagccagctgtgctgtcaccttttcgtttaacgataattgaatgacattgtttttccccgtcagcgaatcaatccccgctgaaattcggccgactgttttcatgacgtgatctatgacgcgtatagtgacagagtacccgttctttaacgcagattgcatgtagcgtttgatacgttccatggcaggagtcacttcgtctgacgcatacagtgaaacggtaaatcctttaaaaccggcagccagatcccgcaatctctcaaatgccgctgtcgcgctgtcttttgctcctattttaacggttaaagacgcaggcagacccgctaattgggcttgcaccttttgaatgacggcactggctccgtcttcagctgaaatagagatcatttgtgcgcccagctttcttttcatagagcgctggatgcggtcaattgttcttaaaacagatttactctctttgcgtatatcaatttcactttggcgttttgtcattttcctgtatttctcaagcgctctgaagccattttggattttccttattttctttgaaacccgatcttccaattcaaaacgggcggtcagctttgccatgatgtcgctccccctttcttcgcttgtttttcaagaatgtccagcttgtaaccgattaaaccgtacaacagcgccttaaaatgtctcggtgcttcatataactctttcagttctgatggagaataatgaagctcatgcatcgcgtaatagagatacacggcttccttattcccatcttttatcagttttttgcttcttgctccagatcttctaattcatcttcaaaaccattgatctcaatcgctttattcagccaatttgcatactcaccgccgactgaaagaacgcgttttgccacctcgaccggatctgccgttttgtaagcgtcgcggagctccttagaccggaaatcagggtaaatcgtagattcaaccgcgatccgcgcatagaagcgctggctgtctaagtcttttacgcggcctctgcccttcacatttttatatgtcgtgctttccttctccagttcgtcaatgcgctcagtcgtaatggctttaaaaataaaaggcacgatgtttccttttttatcgacaaaacgctttgaaagcggaacccggatctcctcagcctcgactgttttacccggcataaagaatgacagatcatatacttgttcgtttttttcgctcatgatgaaaactcccttactctttttttataaaaaaacaggcctataaaaggcctgtttcactcacaatgattctggttaaaacgtttcagaaagcttttccggcacatcgaaatcttcaaaggtaaacggcacttcttcttcgagggcttctgagtctacgtccagtccggcgatttttgcagaatcaaagttgacgtcatacagggtgacgcgttctgttccgcggcctgatgatttgtcgtcaagaacggcttgcagcgtaaaatacgggtcgctgccttttttgacgtaatccatcataaggacggcgaatttggatgtgaccttatagaatgttgccgtgcccgttccgttggcgcctgttgttttatgtcccgtcatgcggcggcccatgatgtttacttctgatttgtttttttccacgtttgcttcaaaggttttaatatgcgccatctcttctccgtcgagaaataaacggccttcttttcctgaaatcgtgttttgcgcttttaatgccatcttagtttacctccacattaaagtagaatttttctgccgcatccacaggctgtacggcgagatcgattaaaaagccgtcgcggtcttcattcagcccgattgtaatgtctttgtctgaatcaaagttagcgatgccgcccgcatcctggagcgttgtcaaatattgaataatcatcgttttgacgaattgaaggccgtcatttgtcgcaggaagatcgcttccggtgccttttttcgatttaattaaggctttcagttcacgtgtcaaatcgttattcaccgcatcaagcacacggacgattttgtttttcgcgaactttttgtttttctctgccgtaaatgtcaccaatgagttgatatctttttcaacgctgactgacttatcacgggcatcataagagaaaaggaattcacctttggaaagacgttcgatcacttcatcatgagtcaagcggtgcagcacatcgacggcgccttcgtattcaacgaatgttaaggattgattaaatgcggcgctggcacttgcgcctgccacccaggcggtcgcatcttcagctttaatctcagttccgtcttccagcagcacaccttcagtcacattgataatgccttcataatccccgctgtaatgggcggtcaccccttgcactttctgtccctgcgcatcgcgaaggcgtttaatgaatgcggcaaatgtcgctttcagctgatcgttttccgcgacaggaagagcgatgacatcgaaattctccgtttcagccgcagctaaaaaatccgtatagtctgagttgaccggtgctttatcagttcctcccgcgagacggatgcctgcctgcgggtttaacgtttccccggattcttcctcagtgcctgtcagcgggatggaagccgacagttcgcccgttcccgtaaatgtgacatagccgtttgcttttaattcttcggcttttttcaccgtttgtttgtcaacttccgcttcatccatgtaagtggtcacatcgaaagcggtctgatcaaggacgttttcactgatgcggatgatgatgtcatttccttttgaacccccgtacaaagcggttgctttaacaccttgcgaaagatctgcgctcgctctgattccctctgtcagacggtacatcaaaacggtttttgctttctttttcgcctcacgaagcagaatcagtgacggatcttcaatactgagccccacttttttattcaaatcctcaacgcttgaaatggaaacgaatgttttcgcttccccccagccggatgcgacgggaagggcgacaatcccgcgttcaccgatcgatacccgctcctgggcggttgttttaaagttaaaatagattccggcacgttctttttcttttccttgcgtaaatgttccgccgttcattattgcatgacctccttggttaaaaatgcttcaatgtaagacttggcttgcgcttttgtcatttgtttttgcttcacgccgaataaagcaccctggagaatctcgggttttacgccgaaaagctccttcgcgtgctttgttaaatccgccgtgtcataaagaaccgctcgttccgccgttgcggcgtttttctttttatattgtttcacttttgtttcaccccgctgttaatgtccacatcccgcagtgcgggagatgtttgtttttgatagtagtagcggctcgtccagcggatggtgatcactgcctcgcctttgtctccgactcttgtttcgatacggctgatgcggacgaaatcaccggtatcctcccctgattccgtaagcagcggaatcagctgtcttgattctctcaccgcatcggcgatcccgtcggctgcatagagggcctgcaccgagtcggcatggaacagcttcacattcagactgtatgtcttcttaaaggtggagactgtgtcattctcgtcaaaagcatacgggggcgggatgtaaagtgacggcacctgaaattgttcaggcagttcattttcatatacgggcacgccgcactgctgatacaaaaaagcggcgattgaaccggtctcgcgattcatccgatatctccccccaacgtgttaagccactgattgaaacgcttgtccagcgattcggcgaagagtgtttcatacaaaagaagggctttgtcccaaaacccatttccgctgatccactgttttttgagcgccattcccgttgaagctgacggatcatagatgaaccgggagccttgaaaatacccgggcacccatctgacattttcatctgagacggtccaatgtccgtcatttatgaatgaggcatactctacattggtgccgatttcaagggtcagtcccccgttttcaatgatccatacgtgatcctgcgctcctttccggaaagaagacagcaggctttctgtatcaatcccgcccgaatgaataagctcctcccgtaccaagtcgagaaaatcctctcctgactgttccagccattcgcctgcctgacgggcaaattctccggatgatgccttttgcagcgaccgattccattgttcaaggttttttatgctcatagtctgtcatctctcacagcgataacctcccaatggtgctgtcttgttttcttcggcatttccagaatatacgcctgtccttcccaaatgattttgtcattgacacgcacaacggcctctttcggaaaatgaacgagaaaccgctgatataccttatgatcaggctcaagctgaataagctgctgctgtttttcaacaaacagacacggcacgtcttcataatcgggcacttccggataagaaaagacaggctggagcttttcggcgggaatcccgaagcgtccggccttcggaactgacaccgtctcatgataaatatcgcatctgtcagtgagcagccgttcgtagctcataaaggtctcacctttgcgtgtgcagaaaccggagaataacccggcgcgatatattcacagagcagatggtgcaccgccggttttctgattccgccttcacctgccaccgtatacgagtagtcgcctatcttttcagattgataggcggaagcggctgcttcattctggttgatcagcgcaaaatattgagaaagctttaataacgcaagcttaatcttttcgggaagcggtgagtaaacagggtcagtgaacgaatgccccgccattctggccgcctccgcctccgcctccagaatgtcctgtataagaagcggctccggcctgtttttgacttgatcataaactgaatatgaaacaacgtcagacggctgaattaacataactgccacccccgtcttattctttaacgtttacgattttggcgcttgcatcttcttcttcaaatttgctgtcaagtttagccgtcagtacgataataaatttgcggctgcgaatatctttatctacttcgattcggatatttcttgaaaaaccgagaatgatatttttcgggtgagtcaaaatgatgtcagacgcatcgtactgggaatcaccttctccgactgagtacggctgcagattggacactcctttgaccggaacgccgaatgctgaagacaaaccgccctgcaccgcaagatctcccagattggtctgacggtcagccacacggtctttccattcaatctccatgccttgagatgtgtaaaatctgaattcctgaggcagtcgcaaatattttgccggaatggcttttaagccttttttaaatgtggctctggacagctcttccccgtttccgtcaatgacgtgagatacagtctgcttacggattccgtcaagctgtgccaagtacggatcagaagaagatgtatcgccgtttacgactagctcctcaatatcgactgccgcccgctccgccaaaatctgcatgatcgtctgctgcaggccgtctttttcaatattgttttcaagcgtgtcataggtgatattaatttccgcaatgacttctttcgtattcagctgcaccgtacttgttgacgggacggtcagctgatcgtcagttaaggcttttccttcctcagcggcacgcagaatacgctggccgaaaccgattttttcaaatttctgcgagtcattttccatttgaatcacacgcgattcgctgaaaatggtcggcgtgttctgcaccatgcggataaatgctgaagcttgtgcggggttcattaaaccgccgctttttaaagcggaaagtgacatttccgcctttctgatgatatcttgatttctcactctacagttcctccttctgactgggcttaaagcagtccgctccaaatggattttttaacaggctcttgaccgcccgtctcttcttccggctgctttgatgcgcctcttactttttcaagcgcttcaatgcgtttaataatcggcgccagcatgtcctcaacaagtgttttcagcttttcttcatcagacggcgcagccgccccgtctttgtcttccgtgttctggtccaaactgtcaagccgctttaaaagcgggtgcagcgcgtgttcaatcgattctcttacgtcttcttttctcatcttgttcaagtcctctcccttgcggtttcttgatttgcggtcacggtcgagaaattgcttgactgcgccgaataagccggcttgcttttctgccggctcttcgtaaacgtcagcggttcccgccatgctgtagcccgtaatgataccggctttaatctgatcccatacttcatcggaagctttggtgacaagcacccaagatcctttccggatcacagcattcccgatttcaaagtcatccggggcgacgtacgactccaccacctcgccggtcccgccttcaaaattatgatttgtatcgatgttgcgggcgtccgccaaaaaaccgtgagcggccttttcaatctcttcagccgtcatataatcgccatgtgcatcggggacatccggctcgtaaacgatgccgtaaacaagcttctgctcatccgattcgttttttgtaaacacctgcacctttttttcaaatgacggaaggcctccggctgattttgtaaaaaagaattccgtttggttcgccgccttatcgacatagctcacaaaactgatgacggcatttctcaattctctcggcacgagatgttttcaccccctttcaggattgctcctatttccctttcagcaccggccggctgtagtactcttcaggccattcctcaagcgtcttgccgagcactcttcccgccagatcacggaggtcattaggagagaccgcgccggcggaaataaatggcgtaagcaccttcgcaatttcaagcggatcgcgaaaatcaggcccttttaatgtgagctgtacatcgtggagacccagttcaggcaaaaataacgtgttgagcttattaatcagcgttttccgctccggctgaaacacctgctcctccgttattttccgtgccgtatcggctgtggctttgttgtattcctgcgcctctcccgtataaagcggcgggagacggaaagcggaacggagtttatttctgcttctgtcgtcatattcaagaaacagcgcatcatcctgcagaatttccgcaagtgatttaatttccacagacacgggcgtaatgtcttcgcctccgtgaaggtctttttccttcgcaatgccttccgcctcaatcagcagaaatttgtgggcgttttccaccccttccaggtcattcatataatcctgaagctctttgtacgaggtttctgacagcatgccgttttcaaccgtaatggcggccggcacgtgacggccctgcttgaaatacataaaattcagttcttccgctttccgggcgccgtacagattgacgatattgccgacccagcgcggaatgccgtaagtgccgctgccgatttttaagtgaatggcttcatttgcccggtattcttcagacagggtctttacgtattcaccggttctcatgtccatcatgcggggatcgccgtattccttaaaaaacactttccgtccgttcagcatctgaacatatttacggaaccgtttttgccttttaatcgttttggatgcgccgttttcttcatatgaaaatgtaacttcaacgggatcagtcacaccgcagacgcgcatatgtttcacatccagatattcaatccccgccggttttcccgcgccgtcccgaagcacttcgagaaaaccgttgcccgttttttcgcggtcttctatcgcatatccgaggaccgtctcggccgattcatcaaaatgaagacatttgtaaaagctctccagcttcatccagtttttttcggcccgggcctttttagacggtgagcaatctgggctatttacatcaaaggtatattccacatcgaacccaaaacccgtaatattgacccgatacgcgtcaatgcactgctgaagaatcgtcgagtattcggcgattgttttcagttcaatgagattatagggcggtgaaatgatgtcttcgccgtacagatcggcaaattgatcttcgttcatctgccttgcctgcggcgcggccatttttgatttaaagacggtggctctaacgttttgatagttaggcaacgcctatctcctcctttcccgattcggacgtctccgtttttgtgatgcatctttcagatccgccgcgtcatagtcatccagcgcataccaaatggctgaaagtgtgtggggatcaattgaaaactcatcttccgacagaacgccgtttttgttttttgcgtacgttaagttctgcaattcgcggatcgtattttcacagctgtctgagcaatagatatgtttgaaccgtttcagcttttttgtatactgaagtcttgagcccggaaactttttggccgcaaccatgcaaaatccctgcctgcggaaatattggatgcttttcggctcagccgaatccgctttgatcagctctttttgatccgccaattcttgaagctcctcagctgtctgatcatcggtcattttgtttttgtaatactcccagaaaatataaagctctttttgatccggatcgacggctagccggatgaccgcattgtatgactcttcaaaaccgaaatccatgccggtccgaaacagggggcgcctgatggacgcaatccgctccgttacttcgttgtgctccatgacctgaaactgcggaaacacgcggatgccgttgacgccgaaccgtcctttgcgggcgatccggtacaaatcaggatcgtaatgccgtaagctgtccagctgcttaatatagcttttcggcaaaaacagattatcgcacgctgtggaatggtggtaatacgtatctcccttaacgacggtgcctttttcatacagcgtctgatcatccaatacgaaccgttttttttggtcatcacgaaaaaaatgccggtacgtccaattggaggtgccgacgggatttgtggtgcatatcatatgcagcgaaagctcgggatgacgcagacggccgatcagctccttaaagccttcatacttcacttcagagcattcttcaatccaaatcagtgaaatatgatgaatggatttcaatttggccgggttgtccatccctttaaacataatccggcttccgtttgaaaatctgagctgcatcggtgaagaaacggcctttacggcatgtcccagttcaagctccgtgataatgtcttcaaataaggcaaacgtagaatccctgtgcgtatcgaaaacttcccgcacgacaagggccgtccgcttttcacgaagcagcttcaggatgattttcagcgcggtatgatagctttttgacgagccgtagcctccgacgagaaattggtacgtttcattccaattgaacaaataatcttcaaagcgcgggttgaccgctttttcaatcatggccgttcctctttccgcgtaatgacaatgtcaatcggcttttggctgtcttctgttttttccatcttctgctgtgccagctttaatttttcattttcgattttttgtttaaattggtcagggaaaaggtcaaagtacaaggacagcttttcaagagccttcatcttgtccgcaagctttattgcaatgccttctttcccgagttttgcttccgtgacgatggttccgtccagaaggtgcgaatctttaacgtcaacgtagctgatctcctgcataatcggattatcattctcgtcaaagagcggccctgattttccgaaggcctgaacctctttttttccgaaggttacataatcggtaatgtcagcgaaagcgattttcacatagacttgaagaacgtccatcgcttcgacaaacactttattgaccatttcctttttcatgcggctgatttctttagcgactttttcgttttttaacagcctgcttcccgtcacatgcgcgctttccggtgaatacccggcttttatcgcagattgggtggcgttaaagcatttcacataataaagacaaaacagccgctggcgttcgtttaactcatcaccttcgcccgggttgttttttccgccgctttccgcgttctttttaagcgcctcgtcccagcgcccttcttttttccatctgccgattgttcttgcggatacgcctgatttgccggcaagggcgcgatttgtgatgcggcctttatgagactgatagattgtaaatgcctgttctctttttgcgtttttcatgctacggcatcaccgccacctccgacatgattgtctataataaaaagcggcttctaatcgggccgctttttgtgatcgtctgttcacttctaggtggcaaacgtatgacaacttatgaagcaggcgattgatttctttgttcctgctgtttttgaattttcagaagcgcccgtttgaccgtcgtttgtacggttgatttctttacattcagcaaggcggcgatccgttcatacgaaaagcattccgctttgtggagcagcagcatttctttttctctatccgttaaaacggctaatgcgtcccgcagtctgattctgtcttcttcagtcacatttgcggacggttcaaacatcagcgcctgcgaataggtttctatgattctcggatctttaatgagcattctctgataagcgtctctgcggtctatcgctcttcttatgccgggctgccggcctttttcaagccattcgatgacatattccaaatctgtaataatcgttctgatgatttttttatctttcagttcttctgaagtaaacaccgtttcatccgctgcctccagctgcttgtaccactttttcgtctctttcagcgtgcgtttatattcaaatagtaagtcttccatgtagatcctcctctttttcggaacaaaaaaggacaccaatcaatgcgcagcatgtgcgcgattgatcagtgtccgcaggctttccgtcttggacgtattctgtttttttcgattaattcaatttaaagccgatttcatattcgacccgggccagatccccttttcgcgtttcgacaagcgttttgccgtgctccggcgcttcggcgagccatgcttccttcttcagtccgtctactataatcacccgaaccttgccttcttccagctggctttttaatgttgtatgttcaatgtcagtcagttttttaggattcatgttttacttcctccatctttttcaaaatgttcacttcatgtatgaggcttccgagctcatttatgaacgcttctttttcttcagaactttctccccggagcaggcggagagccgtttcggccgcctcaaagagttccggggctttcgccatcaatgccgcgttgatctgctgtgagtatgaacttaagttgaaaacggccgcgatgagccttccgtttgaataagggaacttctctttatccgcttcgctgtaagcggaataaatgtaaatgggtttttcttctccgctgtgtacggcccgccatggagcggggctgtttttttcttgcaatggtgatcctcactttccatcagcctcatgccatgcttcaatttgcttttctatccgttttgccctgaacagcaggcaaaaaagccatttgatatatttacacacgtgcatcaagcctcgcttttgcgtcttgaaccattcgttcaagccgtttaatgaccggcgttaaatcagtgcctgttttgcagttcgggcaagggtgaaagacagcgccgaaacccgtttccatcacaatgaccttcttcggcccgcacagcttacacattatctcgccccctctaatctgtggtttacgtcaaatgaattgccattaatgatgactaaataatcgctgcacatctcataaattcttgtgcccaaggcttcatcaacctgcaccaatccgtcacaggccagctcgctcgagataagaaccggcttatgatttaaatagcggtaattcacgacggcgtacatttgttcaatctgccaatcggtcgcccggggttttccgttcagcggtttgaacagatcgtcaataaaaagcacatccgcctgtttcatacggccaagctttgcatcgagcagatcaaaatcattttttaaatccgtaaagccctccacaaaaggaaaatacagcaccggtgtctgcttctgtctcatgacataattgctgagagcggtcaaaagatgggtttttcccgatcccggacgccctaaaagggcaatgctgtttttccggcagtttttcatcttgtcgaagttctcaacatattcaagggcgcactcatatgcgtcgacgactgcctgaggcttgccccgcgtgataaatcctttgaaatccagcttccgaaaggcatctgtaatctcacttgcgccgagaatgcgttctactttccgttcggcggcgcagcggcacttaacccatacttccattcccagctggtttttgagataaccgccctgatctttacagagcgggcagtcaaagcggcttttgtctgattcttccggtctgtccgccagtaatggacgttttccgtttttcaggtcggcaagaatctgctcgatcgttcgttttgtcatgtatcgtattcctctctttttttgttgtgattgtccttcccgcaattcgtgcattcaagcggtcttccataaacttggcgcaatagctgaaagccttgatcgtttcagctgaagaggtgcgccgctgttcaaaagcggtaaagcattcgccgagccatttgattgcttcttgtgctgacgcaccgagggaaacaatacgggcgatggcctgataatcccggggcgacgggtatacgctccgcccctcctgtgcagaccttaatctgataaaatgggcagcaatgtcgttaatcgcttcttcagcagtatgattttttgttatatctatttctctccggacatttttgtcccggtgatccgccgatattgtccggtcagttgcttccgggcgggttaatgtctttttcggcgtgaatcttttcgagtgctttacggagacgatgagtccgtaaggggcgcggacggttttgatatactcatgctgttccaagctctcgagccaccgcctgacggttttttcgctgaccgcgaatacatcggccatttctcttgcttttacgggcttatgtccgaggacgatcccccactttacgccgtcttttacatgttcctttgtcgttgagctgatgaaccataaaaacagccaaatggcggaccctattttgtcataatgttctgaattcaataatccagaatagatgaaaaacgggtagcttttacgtttcataagggacatctccatttttcttcagacctatatagcgttcatactgcaatcggttatcaaatcggaataccggtagtccgcaagcggtaaaagatatcgaaccgcctgcttttcctaaacatctctggtcagccggattgctgctgaaacggatgattatcggctgcatctctcaccctcctgatcaatttcttatcgtattttgatacattttgtatccctatgatgttgattatatacgatacatttcgtatcatcaagacctttttgatactttttttatcatctctttcttttgatacattttgtatctataatcataagtaacttagggtgttgaaaaaagagaggtcatttcggatgataggcggaagattaaagagtctcagaggtaagaaaacgcaggaagaagtcgcaaatcatatcggtgtctcgcgcgccagatattctcattatgaaaacggccgatctgaacccgattacgacacgctgcaaaagcttgcggattatttcaaagtgtcgactgattatttgttaaccggaaaagaaccttcagatgaagacatgtttgccgatcccgacctgcagatcgcatatcgggacatgcaggacttttccccggaaagcaagcagcaggccattgaattcattaattatttaaaagaaaaagagaaaaaccgcaggccgaaacataaataatccgctcttttcctttaaactgcttaacgttcagccgatataaaagctgaatgtttatttttaaaagaaaagggaattgattcaaagtccgatcagggcttttctttctcgcttaaaaaagaacatatgttcgaaagggtgtattcaattgggcgattttttaacacatcttgaggaatacgtcaaaaacttatattgccgcatgggaatgaccgcccctctccatattgatatgcagatgattgccaaggagcttgacatttggattcattttgaagatacgcacagtatgatgctgaagcgggacggcatgtacagcatcgtcctgaatcaaaaaaagtcacccgaagagcaatggcaggattttgcgcacgaactgtgccatgtgctgaagcataccgggaaccattttcatatgaacaagctgttcagggaactgcaggaatttcaggccaaccattttatgtaccacttctgtgtgccgacctttatgctgttaaacatggagctgccccagcggaggagccacgccgttattttaatcgcagccgctttccgggtgacggcatcatttgcggaaaaaaggctcgagctgtttgaacggcgtaaagcaggtattcaatttcagaagcggctcgcttgtctgttatccgacaagcggccgaatgtgtattatggaagcggacagacacacttgcatgccgctgaagaaaaaacgccgtattttattgaaaattagcgattctccgccggcttagaacacagccggcagaatgtcatcattttgacatcggagaaaaggtttttgcatcatgacgctgtaatcaccgtgctgcccgccaagcacttcatgcgccgcatagctccagtgaatgtaagaacgggccccctgttcatttatcataaaaaccggccttcacggtttctacataccgaaaaaacagatcggttggcgtgtatttttctccccggcagccaaaattgctgaacagcgcgtgtctctgcgccgtgctcacttccaattgcagccccattttcctttttgtccgattgacaatgttgccgggatttaaccctgccagccgatcattcttctctgtcagctcggcatcaaatcccgcttcacgcagcagatcacaaatcagtcttgctttttccagatccgcgcccccgacgagtgtatttgcctttttcagatcatgatacccgtgaaaagccaatgcgtaatgatgggcggtcactttttctaaagccagaggctcgtcaaagcgtgtgcttgtcaagtggagagaacggttatcgcaccgcttcgtcccttcaaataaataaattgagctttggtcagaaaatgcatgcaccagctcactgacacccggctcaatcctgccgccgtggggagcgaggacgatacatttacttccctctttttcttcataaataattctgtattccgattcagcagcggaaagggctgcgaaattgtcatatctatctttcatgtgtaacatgctctccttttccagtcagcaccagtttactctactcatctgggaatggaaacctttttatagtatgatttgatagaatacgtatcagggaggagatatcatggggttcatcaacggattgctgggcaatgcgtcgacaatatcgacggctgaagcaaaatcagaactggcccgtattttgctggaaggcgagaatgtcaatgccgcatttaagcttgtccgagatatcattgtctttacggataagcgtcttattcttgttgataaacagggactcacggggaagaaaacggagattcaatccattccgtacaagagcatttccagattcagcgtagaaaccgccggccgctttgaccttgattcagagctgaaaatttggatttcaggcgcggaacttcccgctgtctcaaagcagtttaaaaaagatgaaagcatttatgatattcaaaaggcccttgccgcagtttgtatgtaagaagaaacggaagcccggggagcttccgttttcttgattacagtttttcttcaattttcgccttcgttttcgggccgtaaattccgtctgccgttaatccgctgacggattgaaaacgttttacggcatttgccgttttcgggccgtaaacgccgtccgccccatgattttttgctcctttatcgggataaaaataaagtgcggataaagcgttttgcacttgttttacgtttgtccctttcgtcagcggtttcgtcactttgatcacaccggatggaagcggatatgaagacacagcctgactttttgaagaagaacccgtctgagcgagcttgatcacttgtccgactgtaatgtgattcggatcggtgatatggttgatgctttgcagcgattttacgctgacaccgtgcgatgcggcgatttccgataaggtgtcgccttttttcacatggtattcagacgcggaagaagaaatagaggcttttttcgccggcatacttccgcttaatttcttttcaatcttcgccttcacttcatcccagcggccttcagacaaaatgcggtgcgggcagtactttccgttccagtcctgatgctttctgattctgtcaatcccccagccccgttctttcaaaagctgcgccgcaaacgcaatcgccagttcttctgcggctctgtaccgttcgccgcctgacttgctgtaacagatttctatagcaatcgacttgcggtttccggtaccgttcgtgccgtctcccgaatgccaggcattccggtccaacggaattccctggatcacttctttgtcatcaaccgcaaaatgatagctcgttgattcgctgtttcccgtcatatagctgatttcattagcggcggatgcgtcgtttgccgtgttatgaatggtaatatactccggcgtcatcggattcggacattttaacgcatatttatcagccgatacgagccgttttttcacttcaatccccactcttcatctctccttatgcctttttcatcaataggtggcattcgtaggacagataacttgagcatatcgaccctgcattcggataaaattggaatggacacgcatgcaaaaaataagacccttccaaagaagggtctttatgttatgtttggttgcgtgcggcaatatggaatgtgccgtccgcttggttttccaaatggctttcatggccgatcacctgtgtaaagctgaacccgacagcaacaagcagcaatcctgacaacagtttagatttcatatagacaatctcctctctggatttgtttttgggcgtgcaccattttttcataaaacgtgagcgctttttcaggctgtccgtgtttcatgtaaaatttggcagcgtcatgcgccaattcttccacatacggatacaacatgtgttcttccagaaaatcaaacgtgtgcctgacggatgcgttatccatttccttgccgtataacgcatgcaaaaattggaacagattgacaaacaattcatcattgtattcgcgggcgatactgagcccgaggcgatattgcttctctgcttcggctgtagtgttctgtttataaagaacctgtgttaatgagtaaatagaatgcggaagattatcgaacttttctgacctgcaaatggaaacggatgtctcaaaatattcggctgctttagagaggtctcccattttttcgtaacagtttccgagattatataaggctgaactgataagacggggattgccttcttgttttgcaagatctaaagcaagttctaagtggggcaatgctctttctggatactgcatgtcatcataattccctgcaataacgaattcacattggattctgcggacgttgtacgtctcatacgattggtacgtttcaagggcttgaacggcataactcatggagacgtaggtttgtttcaggttgtaaaaaatctcggccattttaaaagcaaactcagctttctcgatgtcatcagaaacgagtgcaaggtttttttcagcccgtttgtaatacatcatggcgtttaggaacattttctgtttaaattcgtacattcctcgaaaaaaattaaagtagtaatcaagcagtcctgtcagtttatactggttgccttcaatgtcttccaataattctgaaaactcaggctgagaagggtcctcctttaagggcttgatgtaatccagcatgacgcggtgtctgaattccattaatgaataatacagcagcagatcctgatcttcttccatatcctcaatctctctctctacttcacgtttgacgcgctccgcctcaaggacgtgaaactgccggatatgggtataccattcattaattttgagcccgacaaaagaggacggaatagtctgcttcatcctcaataaatccccccttttggaatgaccgagatatgtcatattttatcataattgctagaaaaagaagaacgcaaaaagaccgcaattgtcgaatttcggatatccgcaacgatttatctccatcacaagcttattgcttgtttcttccgtgccgttgatatagcatatccttgcagcttttattctgtattaaatgggggttttcacatgacagcacaaaatcaattggtcagccactttctgtcacatcgaaacgtgacgattgagctggcggaaaaaatcagccgcgagcattacgactacaagccggcggagacatcaatgtccgctcaggaacttgtaaaacacatcgtttattcttttcttatgtttgcaaacgtcattaacgacggaaacgggtcagctatccagaacaaaccgaaagaagaagcggaaacagacctcgtcaaactggctgaagcatgtactgaaaaaacgacagacatcctgtcacagctgactgaagagcagctgaaccgcgaaattgacctgactgcctctttcggcagaaaaataaccggcgcggctctccttcagcttgccatggagcatgaaattcatcataaaggcaatcttttcgtgtatgtcagagaaatgggccacacggaacttccgttttatcagcaaaaatcataatccggccatcatccgccgatctgcgaaataacagcaggcaggcggattttttgttctgtataaaattttccgaaaatttaattgattaccgcctcttaatcatatataatctgataaaaatagtaggattattcaggaggcacacagatgactgtaagcattgtgtttatgggtttctttgtcggaacgctggtcggattgacgggtgtggggggagcggcgcttttgactcctttactgatcgttttggggatcaacccctcaatcgccgtcggcactgaccttttatataattccatcaccaaactgttcggtgtcgtttctcattggaagcagcgcaccgttcaatttaaacttgtcggctacttggcgctcgggagcattcccagcgcaacagccgccatcggtattcttcacttgtttcccgcttttcaccagcatcaggagcagattatcaaacaggcgctcggctacgtgctgacccttgtcgccatttccattatcgcccgcctttttttcgataaaaaactgcggccgaaccgctggcagcaaaaaacacttgaagaaaagcggacactcatgatactgatcggcgtcattttcggcttcatcgtcggcctgacatctattgggtccggctcattatttgcgatcgccatgttatacctgttcagaatgaaaacagcagaagtggtgggaacggatatcgcacatgcctttttgctcgtaactgttgccggtctgttaaacgcaagcttcggaagcgtcgattacctgcttgtattgaatctgttgatcggctctgtgccgggtgtgcttctcggcagcttcttttcgccgaaattctcaccgcgcccgctgcagtttgtgatggcggcgattattttaatcagcgggataaaattaatctaaaaaaagcgtcctttacaggatcgcttttttatttgggaaatccccctcaatccaaagccaatggggtgggaatttctttattaactaaccttaaaagtgcatataattgtccggttttccctaacatcataccaagtcccgaatgatcatttcttattccattttgccagccatttttcaacagggtctctttaaaatggttaacccatatattaattgtattctcaatctcttgcttgcgatttttaaagagagataattccttaatagcgtgaagtacatctatattccccatcgttccatggcataatgagtagccctgacgatgggaatttccattcagcaatgtgtcatctaaagactcattaatatacccaacgtgaatgcgcccgtctacattctcgtatatcctgcttcttccaagaagaataccgcaagacccgtgacaccacattgcggaagaataatccgactcattttttctgttatccctccatttttttattttagtatcaaaaaatttatcttcgtatttgagagctgattcaatcagtctaagtacttctccagatgcctcaatatgcgcataatattcagatagtgcataacaaatcccagtaataccgtgagaaaaccctgctaaaacaacattctcatccgcgtcggatttccaatatgcttcatttctattttgaatcattcttttgcatatttctttacaaactgcccttgccgtatcttccattaattcagtccgataatacctgccaagctgaatcacaacctttaatatacctgcgagtccgcctataaaatcggtatgtgttatttgagcggtttcctgacgaagtttctctaagtatgctttacacatactattcacttcattttccgaataaagtccggtacctctcattttattgacaaaatagatataagaacttgacccgtaaaaagcagagaaatttgttttataaatactatgctcatatatttgattaattgaattcactattttacgaagaatcgatttgactttttcatcattataaataaaatcataagctgaaaaataaagccccactccagctaacccatcgtacagcccaaaactcaacggtcctacggataaggtgccattgggagccgagactattgatacccattgaagatatttctccgattcgattgcttgttttaatatacaatctgtttctatttgaatcagctctttgatttgtatgtcattttttaaatatccaggtacaaaatcatcaatttgatttttataaataatatccaaattagccgccgtggagcttaaggccatatttatcaagctcacttgctgatgcatgtcttcttccgacatattcgctaaacgagttaaaacttcttgtttagcgctttgtttcataatccctgtatccaccacatgtattgaatttgaataaacccttttttcactaataggagcattaaaatagggtatatcaccgatcatcatatccttgatctcaaatggactgatggaatcaaatacttcatattttgtataagcatccttaataaaagataaaacccttatcctttctccataatcttttaaatacataggatggaggagggtttcaagaaatgaagcgtaaacatatgtaggtctgacaataattctaataggggcataatttaattcgcttataaggttccgtatatataaatcttctttcaaaatcaagaatattcttttgaagccttcaataaattctctttcaaattcaaaacattctgctactttatttttgtaaacaggaagattccttccccttttgaagagatattgtttctttcttatagaaattttatctgtttttatatgaagcacttcttctttttcacctttttgattttctgtgtttatcaagcctcctatattagtcagcccattatcttccggaaaactcatatagttaaaaagtgcagattttaatattgttttatttacctgtgctgatgccattaaattaacattttccttgttctcctcagaaaaaaagaggctgctttgaaacagagtctcaagatcaaccaacactggtttatcacgacatgctatgatattttcaaaatgaaaatctgacccttgaaaagcataaataaatcctaaatgcattccaaattggtaataataatttcttacctgttcaatattatcgcacggttcagactgtacatactcttgccacccgtactcaccttgatccaaggataaaggtgtttttaaattagtttgataatactgattgacataatcaatgaccttttcataaaaaacatcaatttcaagtgaacggggtttataaacgagtttgttattctcaaattcaataataacaacacttttaccgccattatgaacatcccctgcattcatattaacctttctcatttttccgaacgaaaagttgaatttttgttggatttttttatagtcattaacccaatgtttaataatagatatagtgaagcgtataaaatcagaggtggatctggagattaaatcttgcaatacaggataattattgagtatttcttcaacaaatgcggagtttttcagcctttctgagaatatatcataatttttagattcatttttttcatcaaactcgtcaaaagtttgatgaaactcatggataagtgttttccccgccaaatagtatatttttttcttataattaattaatatcgattcaacaagacatcccttatccaacagactttcggatggtattctatctatttctttaacaatctgagctttaaaaatacttatataatactgcgcaaaaccttcgaaataatcctcttctttaaaaatattcaacatagagttttcataaacatagttagccgaattctgtgttttgttcacaattatcacttccttatatattcttgactgtctttgacaaaaaagaaaaagaatatgtacgcatatacatattctttttcggatatgtttaatcgttacatggactgacaatggacgcacactttgtcgtcggacagcctgctaaagagattggtattgtgatggttgtcggcgttacggtcatcggggttgcatctgaaccccctgcaaggttttttaattcttcttcagtcattggagtcagtgcttgaaaatcttttttcatgttaattcctcctattgtttgagttttttataaatttcagtcgttacatggactgacaatagacgcacatttagttgtcggacagcctgctaaagagattggtattgtgatggttgtcggtgttacagtcattggagttgcctccgagccccccgccaattcttttaattcttcctcagtcattagttccaatgctaaaaattcttttttcattaaaaatccccccgattgttttttatacttgcctttgcggacatgcgcagcctactgtgatagttggacaaacatgatttgttattggaattgttgttattgatactgagttttgccctccaataagctctcttaattcttgctctgatgtttcatacaacgcgctgaagttctctttcatattccatatttcacctcctttcaagttaataagtctgctggagctgtgattcatatttggtcttaatcgtctttaagtttccattttcaatctcgtagacagattcggagaattcgagccattcggttctatgagtaatagaaattacagtgatatcctttttgtaaatgttatttaatatatttaattctgtatccttatccaaattgcttgttccttcatctataaatagaattcgcggatttttcgctaatactctggctattgagattctctgccgctgtccacctgataaggtaataccattttctccaatcatggtatgataccccataggcatttttataatatcctcatgaatacatgcttcttttgcagcttgtacaacttcttccattgttattttttcattgaaatattttatattatttataatagtgtcattaaacagattgacatcttgaacaatataacctaacgtttctctcagcttaaccatattaacgtcctcgattttgaattcaccgtagcaaatttctcctgctgttttttgataaaggccggcaatgattttaatcaaagtagactttccgcttccagtttttccaattaatgtgattttttctctcggccggatcattaaatttatattattcaaaatataatcgtttccgttgtagctgaaatcaatatttttcaagctgatattatgagcggccgggttaaatagttcaatgcttttatcatttacttcctcatctttttcatccagtacagcctcaaccctgtctaccatttcttcaactaatttaatagactctaaactgccgataattgatcccagcggagacataaaccgtccggcaatgttagaaaaagcaattactgcgcctagcgtaaggcctatagatactgctgaccaagtacccacaattaaaataagtaatggcaaagatagattgattgcattggagaccgcacccagtaaagatgaataattcattcttttagagaaataatctaactgatgattaaagttataatttaattggctctcaatattcctggtttctcctattgtttttataaatgtcattgatcttaagatttcgattagctggctctgaaaattggattgactatttacttcctgttttgtgaacatttcaattttcggaagcaaaattttagtactcatcacctgtatagctgctcccaataaaactataaaagataatatcggagaataaacaaacatgactatgaaaaatacaaatataagactgatatctaatatcaaagtagacgctaacctggaaatgacttcacgaattacagcaatgttatggattctagttgaaatatccccggcagtattcgcctcaaaaaactttaatggaagactaaatattttatgaattattttatcagtcatactcttattaatttttaattgcagtttgataataaatttcattctgattaaggacagactaaagaataatacgattgaaacaattacaatcatgaaaagcattggtatgggaagaattttctcatttccgtcaataaatgaatcaataatatattgagtcaaaaaaggggtcattaagtttaatgcttgaaaaataaaagtgaaacttataataacccccaacaattttttatctttcaaaagatattttccgatctttctaaatgaagacacatcttttaacgacgaagcagtcttatcctttctctcaagttcgttctttctgattaacataatagaaatgccattatagaaggttttgaactcttctaatgtgattgtcagtctgccagacgaagggtctataattttaacgttatctgtgccaaatgcgtcgacaactacaaaatgattatgattccaatgaacaattagcggatggtttttatttaactctttaagctgcgttatattgtctgtgcggaatgctttgaaatcataatcgaatgtttcagaaatccttttcatttctattaaatcagtgccgtctcttccgataatttctttatttaatttcaatttgttaggattgatttttattccctcagccctgctcaaaaccatggctaaacaagtaataccgcaatcaaattgatttctttgaagaataaccggaagctttctttttctaattttcataaatgtctcctaatgtatctacacgtcctatttcaagattgagaatattcggcaattctgcgtctgctgcatacagcattccatatacgatccccgctaaaccaagcattaaattaggtgtttcaacatcccttccaactccgcattggtagaaacctatatttttgtcttgtacactctccaaaatcaagttttttcctatatttacaaattgactttcaccagtcttttttccatattcgatcagtattaaagcatttcccatgtctccgtgacaaagactttgctctcggccaaaaccgtcataaaaaatgttagaaacggttttattcagatcttttttggccacttcggcaatatcagggtgttttgaatctttcaattctaatctgcttaatagaattccaggggatccatggcaccatgcagatgttgcagcttcatttaccgtttttctcagatcaagccagttaccgtttactttttttgaattttcaaaagcaagtccttttcggatgtacatacttatatcttgatgttttgaatgtttctcgagtaattgaagggcatatatcattccagcgtttccatgggaaaaacccgttaacggcttatttgcaataccttcccaagtgacaaaatcctcatcaagaaagatcgcttgtttcattaaaaatgaaccgcattgttcagccaatgataaaaagaatgtatcattctctatttcaaacgaacgtatcattacaataagagcccctgctgtgcccccgattatatccaattctttatcataaggaagcaaggacggaataagctgagcgatttgttttgcattctgtttatatttttcgcgtttagtatacatatagaaattcattaaagtatatactattgaagacactccggaaaaagcacctacagacatactgctgtcttcgtccggtttcacctcaatatcaataaaacgagagatgacatctttcataattttttcggcaatgtccagatacttttcttttttcgtgacgcgccataaagccaggtaggtgaaagccatcccggaaagcccgtcgtaaaaggtatcacccataacggataagttccattgaatttcatcaactccaataggagtagcgttaagccaagaatacgaacttcctttatctgtgtgtgctttgtaagattgattataaatataagcggccaattcctctgctttttctattaagatactttcttggttactactgaaaacatttacatattgtcctggttcttttgttataaattctttcaaaacaatttgccgatcatcctccgaagcaagcattgacagttcgataacatagagctgaaactttaaatcgtcttttgataaatttgaaattctttcttttacactttgagctggtgtttccggaaagtaattttcaattttcttattttttgagcttagtaagtctttctcattcaatttcactttgaaataaggtatatcattattaattaaatcgttgaactcatatttaacaatagattgatattcatcttcttgctttggtctctcccatatttttgataagaaaatttctctatcaatagagttgtgtaaaaatctaggatgaaaacttaattctaataaagcagaatactttattgtcggttttgatataaaccgaacatatatcttgttttcgctcttttctattatgcgaatcagctccgaagcatgttttaatatagtcatatatgcttttgaaaaaccttgcttcagttcttcgacataatcttttgcatatacaaatttattctcaagcatagggtgattattagctgtatcaatttcgacatagtctcgtttgacagacatttctgctgtctttaaattgataagctgaggaactttaatgatcgactttgctttccctttccgacctattccgctgatgtcggctttgcccgcaaagaaaaaaggaagcagccctaatgctctgacagattcatgaagctgcgtttcagctttttcataagcgtccatcccatccttttttttctggtatgcaggatgaaataaggattccaaatcaatgagaactggatagctgccgttggcaatgagattttccgaatgaaaatcaacagctttcaatgcatataacaaaccgatttgagctcctgtacgctgataaaagttttgaacatcttttaaacaattgcatgctttaaaagatataaattcagtccatccatatccgtctctgctaaggacattcggagtgctcaattttatatcatgatctctaattttctcattcaaaaattcaattatctttttatataatagatcaatttctaaacttctcggcttataaataagtttaccttcatttaatgttattttagtaacctttctcccatcagaatgagaatcacccatccctacttcaatgtcccttattttgacttgttctgaaaaaccaaataaagagagcagttcaggcttgtccttttcaaaacgggagataaattccagtatgaattttttgaattttctcagttcatttccaatcgctcttaataagactggatatcgttggaaaaagttttcaagatactcctgactgcacaaaagagttttattataatcaccatatttttctttaggagtctcccctgccaaaaaacctttttcccgattcatattcatatccaatacaagtgttctataggatacttttaaaatgattttttctaattgatttgaaatactatgatgaaaaagagccggttgttccagcagatagtcataagaaggaaactttgattttttaagtagatcattgaagtaagaggacacttttaacgcaaaaacgtgaaacatgatttcttcatttacgtcttcttttttaatagcttggtgagcgatccctttttttaggttttcgaaaacatgaactgtaaaagcggatttatgtagtggggtttgatataagcttttcactttatcaattgattgaatggataacacattataaatgctttcctgggccatttgaatatcattcttatagattagttctaagtttcgatcaaacagtttctcattttcatcaaattgagagacagcagcttttttttctttacttaatagaatattagttagcgaattcatttaatattcatctcctttaaaaaaagagggagacagctggatctcccagagcattggaaatctattttcttatttcgggttgttttaacaccagcaagtgtgagtaggacaaagaccgcattcccaagttaacgtacaaagcttaccatcatttccttgagaaatccctcgctgttctgcgcctcctcctccgctgaattcacttaaagaaatttcctcaagttcttctcttaaatcaccggcaaaacgatacattttctcattcattaatattcctccccttgatttttgaaatatattggattttgatccatatatttctataaacctatgataaacgatcttttacctataggcaccgaaaagtcatattcggaaaagcgctttttttttgcgcgtttccgaagtataggttataaagaaaatcgggattaactgttccgttaatcccgattcatttactcatatatagttttcatagaaattaatgaatatcgatttgctttgatcagtgcctctgttctggattttactccgagcttgttgtacacaccagtaagaatgtattcaaccgctctttgactgatcaacagctttgctgataattcccggtttgtcattccctccgctacgcccgctaagatatcttgttctctttcatttaaagtaatatctcttattctatcttcaagcttatcaatgttgaacgtatttgcttctgttcttcttaattgtttaaagagatgagtaggaataatggtatctccctcaatgacactttcaattacttttatcatatgttcttctgttgatgacttacttatgaacccggaaacaccaacttcaaccaaaagattgaaatgcacagagatatcaaaaccagtataaattataattttttgatcggggctctctctaagaatcatttttgacaattccattccatttaactccggcatatataaatcaagtaaaattaagtcatactcataatgcttaaggtgattaagtacttctttacagcaagacaatattgttactcccattttattgcttttttcaagaatggcttttgtcccttgagcaacaccaatatgatcatcaattaatagaatctttatcatgtcagcgctccctattcatttttcgtacttatttcaaaccttaacagcaatccttcatttacgcttgaagatatattatgaataccattcatacaatttatccgctcttttatccctgtcagcccaaaactgtttgtttttgaatttactttattccaatcaatgccgattccattatcttcgtaaacaaacataagacttgtttttttttgaatcatcgtcaaaacaatataactggcttttgaatgttttacagcattagtaagcagttcttgaacaatccggtaaatgtttattgtgatatcttctgtaaaaatagaatcatcttttacatctacaaagaattcaatatcaagctgatagttgcttttatgtttatcaatcaggacttgaatgcttcgaagaagtcccatctccattaaaaaaggtggtcttaaatcaaaacatttttctcttatatactggatattgtccagcaaaatttctcttatgtaataaatatccttgtatttctcaacatgatactctaattctctgcatacaaatatcagctcttgaatgatagagtcatgaatatcctgtgcaagcttggttctctctatttctgaaattgaaaataaaaccttagaaagtacagccgacttacatttatgttgatcgtctatgataatttcatcaatttttttttgaatcaataatttgttctgaagtgcagatgctgtgcagaatgccagcattcgcagccaatctgcctcgttttcacgaatctttatagggtgtccttcatgtgataaatgaataaaaacaaatgtatcacacttctccccgataaacagaattgatccgctggcggtttcacgtatttctcctatcttaaaatttgaaatgtttatgttaggaacttgaatgtttttttctctcaattttaatgtttttttgtcatagtttataagagcaatctgctttcctgagagcacactctgtatttcattggttagttcttttatcaattgatctgcatcggatcccttttgacataattctgaaaaacggaacaggctgcgaagatatgtcttatttctgtcatcataggtaaagcataaacaactactgccgaatatacttagaacaaaaaatagactatactgtttaaactgtaattggctgtctgttataagcaaaagcataaaaaacaataataaggagaaaacaaaagcccttgcaaactgctcaatattaagcttcacccaattatctttcatttgtatccaagccccttactaaggaaaataagggaatccctttgaatccccttaaaatgaaaaagttactttacacttattaaaatataaacagcaaaggcaacaatgtataccagaaatgatccagtcataaattttacaggttttcttgaaaagtttagtacgcctcttaatccgtcattcaaaatcattccgaaaaaggtaaccagtgtaactcctaaagcgagcattgaaatcacaaaaataacttgctccatgtatactcatcctccatttacattctgttttttttcgaatatacgtataatcctgataaggataccaaaacatacagccccataatcagtaatccccaaactaaaagaattgaattggtatatcccatatcactttcagaaatttgaatactgaaacgataaataaaagaaaaaggaaagactattgagacatcacttgctaacagtatcgtcattattaaaaaggaagctacaccggttatcatgacaaccactagatttttacttaagaaagcaattaaagctgcaatcggaatggttagcaggctcaaagtagtagaagtaaaagatgtcgctattaatcttaataagtcgcttgctgagatatcttcccgaaaaaagaaaaacaaggtggataagtgaataatatgattaacagctgagattaaaaacaaaaatagaaaagctgcagctagctttgataatatcaatttgaatttatgatacggatatgacatccaattcaacattgtcctgtttttaaattctaaataaaaataaaaacctgaaaaaataaaaataatagtcggaaataggatcgaatactgattaaaaacaaacatataaaatttgttccaatctgtattttcgttcatagtcaaaagaccgattccgtttatgagaaatggcaaaaagcttagaaagaaaataacataaattgatttcagtcttttaagtttcagaaactcgttacgcactaacagactcatgacctttctcctttgccagcagttttaaataaagatcttccaaagatagcttaaatccgtcaatagacgccttgttaaatccccaagaatttaatttctctttcatttccgacggatgaattattgaaataaactcgaattgctgtttattctttgaaataacatgatccgcaaatttctcaatatccgcccaattaatacccgcttcagctggaattttgtacaaataaagatgttgcgtatttttcataaaggctgactcgaaaataatctgccccttattcataataagcaattcatcggccatgagattaatctcacttaaaaggtgacttgaaataacgactgtggttccatttttcattacctcttggatcaacatttcacgtacttctttaataccatatggatctaaaccgttcgtcggctcatccagcaaaagcaatgcaggagcatgcgcaactgctctggcaattcccagcctctgtttcattcctaatgaagtttgcgaaaacagcttatctttatgttcaaaaagtccaacctttcctaaaatctcatttatttcttcatcagaagctgatttttttaaatagttaagatgtaatttaatattctcaaaaagattcaaattttcataaaagccaggaaattctataatgcttcctatagactgaatcacatcattatttggatttccatataagtcatccccctcaaaaatcacttcacctgaagttggaggaaatatccctaacagaactttaagcaatgtcgtttttcctgcaccgttgggacctaataaaccatatattttacctttttccaatgttaaatttatatcatgtaaaatttctttcttttttatagaaacattgatacccttggatattaaagctggatcagcctttcccacttttcatcattcctctccgtcttgttctgtttataatataaacttacgaggttaaaaagaagatatagtcaaggttaatttacgtttaaatttctcaatataaaaaatacgtgaagcctctacggcttcacgtattcattgctgtttggataaataataaaaaccgttccgttttgattgctctttattttatgttcaagccccatttgtttaagcatcatattaatgatcgataagccgatcccggcgccttttctttcagatttataattcattcccgggcccctatcctcaattatgattacgggtttgttttcaattagctttgtctgtacggaaacgtattttcctgaatgagcatggcgcaaaacattttgaaaaatgttatcaagaattctcttcagccaagtctcgtctatttcccatacgatgttttccttcagatcaatatctattgtgaagtgctctttctcaaaaattggataccaagctgttaacgaagaacgtattatctttaatatgtcacaactctttttatgaagcggcaatttacctgcggcaagaagagaaaatgatgacaaattgtcaatcagttcgcccataaacgttattttatcgtttatgatgcctaaagaatgctttccattttcactgcttatttcattcttcaacgtaaatgtatgccctcttataaccgtaagaggggtccttaaatcatgagataaatcagcaatcaagttttttcggatttcgccttcttcacgctctttttgtctgctgttccttagttcctcaaccatctggttgaatgaatattccacttgacccagttcatccttctgtttaactgttacaaattccggtatgccgtcattatcttgttttttcatatgattccccaaagaaattaaccttttttgtattttcgcaaaaaacatccatgaattaatcacaaaaagtgaacagacaaaaatcaaggcgataaaccatatataggaatacttggccctcataacctcccattgagatcctataattgagcgcggagtttctaaaaatgcatatccgctgtcttcactcccatttacataagcactcagcaataaatatttcttttggttttgttccatcaatttaatcaattcgctaacgtgaataacctcaccctttttggccaaccgttctgagttcgaaaacatcacctttcccttatcatttatccatacaatatcagagtgtttatattgcttcatgtgcgggaaagcagacgtaatttcccgattggatttccctgaaaaaccttccacatcagacttccaatcactttccaacttgtttggttcatagtgtacttgcccctggtgatcaatcaagtatgttaatgtgacatagtaaagaaaattcacacctaaaaaggctatcggaaaaaacaaaattgaggcaacgatattaataaggtattttgttgataatttcattgtttaatcctgtatccaatccctctgatcgtttcaagaatttccggctcatttggattgatctcgattttttgccgtaaatgcctgatatgtaccatcaacgtcttatccccttcgatataaggctgctcccaaatattttcataaatttgttcctttgttaatatttgattgggatgtctaagcaaaagcaaaaaaatccttaactgcttatcagttaaaaatatttcctcatgactttgatgatttaaaattcttttttctttcaagtggacacttaagtgttttagcttcaattcatgaatggcagtcttgtcaaatcttcttaataatacttcgattcgagcggccagttcatcgggatgaaagggttttgtcacgtaatcatccgcaaatcctaagcctttcagtttatcttccagacccgttctcgctgttaaaagcaagagcgggatctgcggatgtgtttttttcatcctttgaccgattgtaaatccatctaaaccgggcatcattatatcaagcacgatcagatcagccttttctatatatgtttcgtaattataggaagaagtgagccatataatcatatagccccgatcttctaaatcatcctttacaaattggccaatttcttggtcatcttcaatgtataaaatgttattcattaggaccccctctgaaatatgtgactaaaaaccaatcttccataataattatatatattataaaaatctcctttatgtaaggcaccattccattattatagctcatagatattcacaattcatcaaggggcaaaacgataagtgaatgcgaaaaggcggtctgttgtcagatcgccttttcccttataacgtcacaccggacttaaagattgcaagctcccgaaaatcgtttttttcgttattgacgtattctccgcttgcaactttaataatgtattgaataaaatctctcacaatgtgatcttctgttgtttggtcttccgccaatctgcccgcattgtaatcaatccaatgaggttttgattgaaataaatcggtatttgttgatactttcacagtcgggacaaatgtgccgaacggcgtgcctcttccggttgtaaacaacacgatgtgacagcccgccgcagcgagcgctgaagaagcgattaaatcattgccgggcgcactgagcagtgtcaatccctttgttttcagtgtttcaccgtatgtcagcacatcagaaaccggtgcaagaccggctttttgggtgcagccgagcgacttgtcttcgagcgttgaaatgccgccttccttattccctggtgacgggttttcataaatcggctgctcgtgcttcataaaatattgcttgaaatcattgatcaatcggactgttttatgaaacacttcttcactcaccgcacgctgcatgagaatcgtctcagcgccgaacatctcaggcacctccgttaagaccgtactccctccctgtgcaatcaagtaatctgaaaatcttcctaataaagggtttgcggtgatgccggaaaaaccgtccgacccgccgcatttcaatccgatgctcaattctgacaggggaatctcctcacgtttatctccctttgccgcaaggtgtatctctttaagaagcgctgtccccgcttcaatttcatctgtgacagcctgtgattcgagaaatttcacccgatctccgttcacttcagaaagcgtttccttaattgccgccagctcattattttcacagcctagccctaaaaccagcacaccgcccgcatttggatggcgaatggcgttaatcagcatttgtttcgtattctcatgatcatcgccaagctgggagcagccgtattggtgctttaaaaccagcacattgtcaaagggggcaatgtctttcgcctcttttacgaagcgctgcaggattttctcagcgacgccgtttacgcagccgactgtaggcacgatccacagttcattccggacgccggatgtaccgttttctcttttgtagcctttaaatgtccggttctcatttgtaaaaggattgtcctcgaagcgcggtgaatacgtgtattcttgcacatcggataaattcgtttgcagattatgggtatgaatatgctcgccggccgaaatccgccttgtcgcacgcccgattgaaaaaccgtatttaatgatgctgccgttttcttcaatggtttgcagcgcgattttatgcccccgctttacagggtccttcacttcaatcgccagtccgtctgtatacagccgctcccctttgttaaaatggcgcatagcgagaagcacgttatcgtttttatggatttttatgacctctttcatttcacttccccccttattgccgcagcattcatgtaacgcatgcttcatcccccgcttatgaatgacagagagaaaaaaagccgttcgttcagtcagccccggaagatggttcagattctttccccacaatcgctcttctcctaatatagaaaatgccgcttgaaacatatcatctttgcaacgggaccgcgccatttgaaaacggttcagaacctcctcgccatctgccggtttgttcagcccgttccagtatgaatagatcatggcgctgaatgaaaataccagcctctcaggaagccggccctcctgttcgatataagccttcagcgtcggcaggtttcttgttttgaatttcgcggcggcgttaagggtgatgctttgcagataatgttggatataagggtttttaaaccggtgtaacacatctgccgcatactgggtgacaccctccatttgcagcacgggaaggatttcttcattgatcagctcttcgatgaatctgcccgtcacctcgtgctcagccgcttcccggacggttagcagtccgtataataaagccactggcgccaatgccgtatgagcgccgtttaagattctcaccttttttgtcctgtaaggcgtaaggtcagacgtgatcagtgcgttcagcccggcatcagcaaaaggaagctcattctgaagctgttccggcccttctatcacccacaaataataatgctcaccgaccacaagcagacggtcttcgtatccgagaaaatcggtaagttcttccgcggtatcaacaggaaatcccggaacaatccgatccacgagggtattgcagaagatgttcgcatcatgaatccattgagtaaaatcaggctccagctcccacagcccggcatattgaagcacggcagccttcagtttccgtccgttttcttcgaccagttcacatggaagcacaatgcaccctttctcggcgtcacccgcaaatgccttatagcggaaataaaggaacgccgctaatttcccggggaatgttttttgaggcctatcctcaagccggtcgcctttctcaaacgtgattcccgcttctgtcgtattggagatgataaaacgaagatcctcttgtgctgccagccgtttaaaggaatcatagtcagaaaaaagatcaatgccgcggctgatggatttgacgatcgtgtgttcttcagccggttttccgtcctttatcccccgcaaaaaaagcgtaaacaaaccgtcctgttcgtttaaacgttttattttctcagagcctctcggctgtacggcgacaacgcttccgttaaaatccgtcaattgattcaattgatcgatctgccagtcagcgaaggcccgcaaaaagttgccttcgccgaactgaaggactttttcaggatattgaatgtattttccgcacatctttttattcagctgccgcaagctgtccgcctccttatatttatgcacacgttaacattctcccgtacaaaaacccggataatcagacgggccgttatgtgagttttttaattgaatctcttatcatcacctcggtgttttcgtatattttttccgccgccgtatccgggtcggtgataagcgccaaaattttctctgcgccgagtatgctgattttttcaaccgggcgttttactgtcgaaagcctcggcgtcatgtattgggaaatgccgatgtcatcaaacccgataacggaaatatcttccggaacgttcaggcctttggcgaaaatggtattcatcgccccgatcgccatatcatcgtttgaacaaaaaacagccgtaggcggtgattgaagcgccaaaagtttttccatcgcctgactgccgctttccatatcatagcggccttttacactgtattcatgcttaatcgggatagaatgatcaattaaagatgtcaaatagccttctttccgctgagaagctgacctgaatccttcctttccctcaatgatcgcgatatctctgtgtccgtttgcgatcaggcagtcgaccgcctgtctggagccttctttatcgtttgacaggatattcgtgatgctccggtcatcaatgtcccggttcagcacgacgagcgggatgtttttctcgcggatatgataaataaatgaattatcactgtcgctttggctcattaaaatgattccgtcatatctcatgggcgtaatggtttcaaagcttttcagatcgtcaatcgcgcggacgaacaaattgtattcctcactgattgtgcggtttacacctttgatggtatcggaaaaaaagctgtgtgaggttccgtttgtgatgcttgtaaaaaacagtccgatcgtatgggacttttgcatggcaaggctttttgcatttacattcggtgtgtaattcagctgtgaagcgagctctaatattttctgttttgtatgctctttaatgtaggggctgccgttaagtgcccgggatacggttgtgtgggatacgttggcgagttttgcgatatcttttatggttaccatcgtttttcctttctttctgtatgctgtcatttatttctattgtaccattaacggacagtccataaaatcactaaagttgaggttttgcatgatgtaagtcctgaacgagctcgtcatgctgccggtccgtcagtttatacattaaaccgataatcagcatggcgcacgctaaagcgaaagccgggtacagcagcagaagccctttaatcccgattaacgtgccttttgtctgagacgcattcgggatatagccgataacgctcagcccgatgcctgaaagaaaacctgataaagattgggcgagttttctggagaagttgaaaagcgaatatgtcgtcgcctccttccgttcacccgtcttccactctccgtaatcaataatgtccgacacaagcgcccacgtaatgccgtttggtatactgatcccgataaaagcaatgctcgctaacgccgtaaagatatatacatttgacgggagacagaaattcagcgcatcagccgcggcgctgacggcaaaaccgatcatcaccgtttgcttttttccgaagcgtttgacgagtttcggcataaacaacacacctaaaaatgaagagccgatgatgataaaactcatgtaggacatcagctccgcattgttgagattgtattgggcgaagtaaacaagcatagcggatttaatgttgtatgccgatattgagaaaatcgtcatgaaaacgacagtcagaagcggtttgttgccgataaagcatttgaaaaccgacatgacggacagcttttctttcggcgcttcacggacgataattctttctttgcagtttcggtagcagatcataaatcccgcgattccgattacggccatcattcccatgactgccgggtagccgatgtgaacgttatcaaaatgaacgagaatcgggatgacgatgacacttgtaatgagcagcgcgccgagagagccgatctggcggaatgcggaaagcgccgttctgtcctccgcatcctgtgtaatggctgcaccgagggagccgtacggaatattgacgaaagaataagcgaccccccacagcatgtaagaagcataggcgtacacaagcttccaggtgacactcacgtccggtgacacaaaaatcaatacggtcatgaccgcaagaataatacttccgaataataagtacggcctgaatttcccccggggtccgatcttttttctgtagtcaatggccgagccgacaatcggatcagtcaaagccgcaaacagcttgctgaccaaaaaaatactgccggcgaacgctgccggaatgcctgcgacatctgtgaaaaacttcagcaaatagatctgcccgagatcaaacataaatccgttcccaaaatctccgaaaccataggatactttttctttcagactcagcttatgctccttcacttttgcggcaggtgctgtcacgacaggcacattactcataggccacctctttcattccattttttaaaagcggaaatattcctcagcattccggtaacaaattccctcgacaatcctccctaaaagctccatatcgcagggcgcttcgccttgttccgcccagccgccgatcagcgtgcagacaagccgcctgaagtattcatggcggggataggacaggaaacttcttgaatccgtcagcatcccgataaaccggctgaacaggcctgtgtttgataacgctttcatttgttgaagcattccatctttcgtgtcattgaaccaccaggctgtgccgaattgaattttccccggtgttttcccatcctgaaagctgttgatcatgctggcgataatatagttgtcattcggattcagagaatacaaaatcgttttaggcaattgccactttttttcggcggaatctaacagccgggcaagcggttttgcgatacattcatcattaatcgagtcatatcccgtatcaggaccgaggctgctgaacttatttgtattggtatttcttaacgcgttaatatggaactgcatcgcccagtccagttcggcgtaaagaccgcaaagatattgcagcgtccgtgttttgaatttcttttcatcttcaaaagacacatgctctccgcttaatccggcggcaaaaatccgggccgcttcctcttcggtcgtctcggcataaaccatttgatctaatgcgtgatccgacactcttcccccggcattgtgaaaaaagcggacgcgggattccaacgcatccaaatacgattggtaggtggtgacagccattccggaagcgctctccagcgaccggacccaatcggcaaaacccgggctgctgatgtccagacctttgtcaggccgaaatccgggcagcacttgaaccggaaaatcactttctttcaacatttcatggtatgtcagcgcatcggcaggatcatcggttgtgcaaatgactttgacatttgatttcagaatgagatcccttgcgccaaacccgtctccctgcaggagctcattcgtatttttccaaattgccgcggccgttttttcattcaatacgtcataaatgccgaaccagcgctgcagctctaaatgcgtccagctgtacagcggattgcctatcgccatcggcaccgtttttgcccaggcgaaaaacttctcttcatctgaagcgtttccggtaatgcagcgctcttcaatgccgttggccctcatgatccgccacttgtagtgatcaccgtaaagccatgcctccgtaatggttgtgaaggttttattttcatagatttcctttgggcttaagtgacagtgataatcaatgatcggcatgttttcagcgtattcccggtacagcattacggccgttttactatccagtaaaaagtcatcacccataaaagctttcacactctcatcctccctcttaaaaaatgttaacgttaacaaaatggttcttttttattttagcttcctctttctcacatatcaatcatttttattttatttttcagaaaattgtatctattaacatttttatgcaaaaaaaagacattgccgagaaaagtccggcaatgtcttctgtatgatcttaaggattagtaagcgaggctgaataatcctttgatatgtgttaaataacgtacgttacttgcttctttcattaaagatgccggaaggcctttcagcggagtagagttcgctccgatgatggcaaccgcgtctttacgtccgaggcttgcaagcgtaccagagtttacaggcttgaatgtttcaagcgtttttccttctaagtaagcgaacaggttgtaaccgacaagttcacccatctgccaagcgatttgcgctgtcggcgggtacggacggccgtccggcgcaaagtatacagcgctgtctccgacaacgaatacatcttcgtgagaagtagattgtaagaaatcgttaaccgtcgcacggccgcggttcacttcaaggccggattcgccgactaacgggttgccttgtacgccgcctgtccatacaaatgtgttggcaacgacttttgaaccgtctttcagatcaataacgtttccttcaacatttgtaacaggaagacctgttaagaactcaacgccgcgtttttcaagactttttgtcgcgcgttcgataaggtcatcaggaagaacaggaagaattttcggacctgcttctactaatttcagtttgatttctttcgggtctacgccgtattttttcgtaaggttcggcatgatgtcagcaagctcaccgacaagctcgacgcctgttaagccgccgccgccgataaggatcgttgcatcagcttcgtttttcgttttagagtattcacgcacacggtcttccacgtgtttgtatactttgttggcatcagcagcagatttcagcaccatgctgttttcttcgagtccaggaatgccgaaataagccgtaacagaaccaagtccgacaacaagcgcgtcataagtcagcttagaaccgtcagaaagggcaacttctttcttatcaactgagaaagaattgacttctgcgattttaatgtcaacgtcttttcctttcagaagtttttccagcggcatagcaacagcctgttcagacacgttgccggctgcaaggcggtgcagttccgtaatgatttggtgagtcgggtatttgttcacaacggttacgcgtgcttcatctttactgtaatgtttgcgaacggttaaagcagaaagaactccgccgtaaccagcgcctaaaatgacaatatgttttgacatcgtatatcctccgtcctttatatcaatttgaatctgagattatttttgtttttcgttcatgatttcaagatagctgttagcaaaacggaacagcttttgagcttgaggatctttcagcatgcgcagcaggccgaaaagtccgatcgtttcattgcttgcatccgcgcggtcttttgcttcgatggcagtagccgcaacttctttcgctgtttctttcaccggctcaagaatttctgtaagcgcacccactgtatcgctcttcaatacttcgtctgtcgctacagactgtgcaaaatcataagacttcgttaaaatatttactaactcagtcagttttggaagctgatccactaaaacagtcagtgattcttgaacttcaggttttagcagctgatcaataagatcgcgttggccttggctgacagatgcatttgtttgatcgattgtttctggcatatccgattctcctttactataagcagtatgctgattttttttggaaagggtagcctttcccccttcatgcagaaaagcatgaaaaagcaagattgtgaattcatgcacaatcatttacaaaaataaatgtttactacccagtttttcactttgccatatccagtattatttttatatcaacaaaaacaattgaataagtcaaaatttctttttcctctctgaaaatagcaaacataaaaaaccccaatttgatttactcttatataataacactttttgaacaaaatttgaacgtgaattgtttcgtttatgaaattatttatatggcgggggtgtaataacgtttcttttaggctatttttttacagaccgtccgcttttcccctgtcatttttcccacaattctaaaagcgggcccgattttcccgtaaaggggtcacattccgggagcgggacacggctgatttcttctgaagttctatcatttttctccgtttttgtatcgtactgccggccgcccggataagccccgatcacggtaaaatcagaactgcccgacagttttttatgtccggtgcctgccggaatgaccgctgcgtctcccgtttgaagaacggcgtccgccccttgttccccgccgaacctcaaaaccgcggttccttttaccgcgacaagaacttcgtgcgtggtgctgtgaaaatgatgatacggaaatactccgcccgtccagctgttagaccaatcgtgccggcggaggacggactctgctttctgtaccgtttcttcattaaataccgctttataaataacaagcggaagattcgggttattcggaatgcggccgtcaccttcgaaataaagcacttgaatatcctctttctgcattgtgttcacctccgtatatgtctgtttcccattcatcatttattaaaacgctattttctcatattccattgcgaagcctgccggtgaatagtatagtataaaaaaatatgtgtcaaaatgagggatttaatgaaagccatcgtgatcggaatattggcatctctgttttttgcagtcacatttattttaaacagggcgatggagctttccggcggaagctggatgtggagctcttccctgcgttttctttttatgattccgtttttatttttgatcgtttatgcgaaaggaaaatgggcgccgctctggcatgaaatccggaaaaaaccgtttttttggctgaagtggagttttaccgggttcgtgcttttttatgccccgattacgtttgcggcggcatatgggcctggctggctgatcgccggcacgtggcagattacaattgtcgcgggtgtgcttctgtcgccgtttttctgcgaaacaaaaaattcaccggcgggcccggtttccgtcagacaaaagatcccgctgatttcgctggttacttccgtcatcatcctgatcggagccgggctgattcagcttcagcatgcgggttctctgtccggccgcacgatactattcagcgtggcgccggtcgtcgtcgcggcgtttgcctatccgctcggcaaccgcaaaatgctggaacaatacggcggaaaactcgatacgtttcagcgggtgctcggcatgacgctcgcaagccttccgttttggcttttgatcgccgctttcggctggtatagagacgggcttccctcaatgggacagacattccaatcctttatcgtcgcactcagctcgggcgttatcgcaacagtattatttttccgcgccaccgatatggtgaggaatgagccgcagaagctcgctgctgttgaagcgacgcagtccggagaggttctttttgcactgatcggcgaaatcgtctttttatccgcggcgtttccgtcacttctttcatttgccggactgttcattattattgcgggaatggtcatgcatacattcgcttcccggcagacagaccagaaaacggcggagcaaacgtcagccaatctcaccggttcctgattttttacgaaaggtgtcatcctatatgaaagaagaaattccggcaatatcttttctgtcagccggcaaacgctttgaacaaaacaatacgtcctttgatgtcctaagccgtgtaaccggacatatccaaaaaggttctatcacggcgttgatagggccttccggcgcgggaaaaagcacattgctgtcactttgcaatctgatgaatacacctgatgaaggggaagtgcttgtattcggaaaagaaataaggcgctgggatatcagggagctcagaaaaaccgcgggccttgcatttcaatcagctcccgtcacggagggcacggtgcgggacaaccttctgctcgcagaaaaactccacggggcgcagcactatacccctgaagagctcgcagattttacagaccttccgcgcgggcttctggatcggaatgcgaaagaattatccggaggtcagcggcagaaactctcattagcgcgaactctcgccggactgccgtccatcctactgctggatgaaatcacctcggcgctcgactcctcatccgttctcaccattgagaaactgattacgaaactccatcggcaaaaacagctgacaatcctgtggatcacccataaccttgaacaagcagaacgattatccgatacggtatggtttatggctgagggacggcttttagagaccgcggaaacgaaaacgttctttaaggaaccgaaacacgaaaaagcccgggcgcttttacaagggagcgggtgctgatatgaatgatctttcactgttactaacaagtatatttgtcattatcgctttattcctgtctaaatcttttaaagccggtgtcgaaaaggatatgatcgtcgcaaccgtcagggccgtcattcagcttctcatcatcggctatgtgctgtcgctgatttttcgcggtgatcacccgatatttatcatattaatggtgcttctcatgctcacggccgcttcgcacaatgtcgccaaacggaaaaaaatgcggatcggctcattttggcgcgtttttctgacactggcaatcgcggaaaccgtgacgcagggacttttactgacccttcacatcattccgttcacttcaagatatgtcattccgataagcggcatggtcatcggaaactccatggtgctctcaagtctgtttttaagccggctcagttcggaagcagacctgcggaaagaagaaatccagctgattctctctctcggaggaacgcctaagcaggccgtccggcagatattgacgtccagtatgaaactcagtatgatcccgacgctagaaagccagaaaacattgggtctcgttcagcttcccggcatgatgacggggcagattttagcgggggctgatccgatacaggcggtgcgctttcagctgctgatcgtttttacaacgatggcctccgctcttcttacatgcatcatactcagcgccttgacatatccttcccttttcacggaacactggcaattaaaaaaattcagcagggaagcgtaagcttttttccctgctgaatggtggtttatgacaaggtcagagattcatagtaacgggataattcaattatcatcgctcccatccgctcaatgtccggagcaaggaccctctttaccccttcatcccggatcgcttcagccgtcactttgccgactgcggcggcaagcacatgtttttcgaatgcctgctgcaattcttttgcggatcctttttcttttgcataatcaaagagagagcgcacttgaatggctgtcgtaaaacatacggcatcgacctctccgtttaacagctctcccatcagtttatcgaccgtctccctttcaggcggaatatgctgatacggcagaacagggaatacctccgctccgtttttctcaaggaactccgttaaaaccggcgctttttcgccatgaagctgtatcataacttttttatctttaaagtcaaatcgttccaaggagcggatcagccctcttgttgtaccgtcttcatctgaggcatgcggcgtgatgccgagcttttttaaggccgcatatgttttatagcctctgcagccgattttcgcttcatgaatggccgctaaaaattcttctttcagaccgattttttccgataccgacaataacgtttccgtaccgatgcctgtggtgaatatcacccagtcggctttttgctcggcaaatgttcttacgtcgggttccatttgatcctccgccaggtatacggttccttggagggaacggatgaccgccgttccgccctgcttttctattaattttgtgatctcttctgttttccgcgaaccgccgatggcaatccgtttcccgttcaatccttttcccatcgctgttttcttcttcccttcagatgccgggcgccctatggcaggccgtcatttatttctattattgttacgcaatcagacgggaaaatcaagctatgctcccgttgaatcccccgtgcagttgctgtatcattaaccggacagaacgatttgattcgcggagggactttcaatcatggaaacaaaaaaagagttcgagacaaaaggatacgatacttcggtcatttatgagttcaatgaatatcctgatgttcacagcggccgatgtgacaattgcgactacacgctgtttaaaagctcagtgaagggcggaaaatttttgagggaatgccggagatgcggcatgaagaaaaacatataacaaaacaggcagccgtccggtgctgcctgttttcctaatcaattttcgacggacgccgttttcaaaaattcttcaatggcgcaaacagcctgttttggaccgccggtttcttttattttctgctgcatgcttttcacgcggctgagaatgtttttatcgccgtatacgttctgaacgtctttttgcagacgggccacagtgacttctttcagcggcagatgcacgccaagccccaattcatccacacgctttgcggtgacctcttgttcgtgcatttgcggaacgacaacgagcggaacacccgcattcatcgcctccattgtactgttcatcccgccgtgagatacgaacagctttgctttctccagcacatcaagctgcggaacgtgctggcggatgataaagtgatcgggcacatccgaaaaactttccggatcaattgttgtgccgactgacataataacccgccagcccgagtcccgaaacgcgtcaatacacatccggtaaaattcaggccaggcgttaaacgccgttcccagtgagatgagcataagcggacggtcatcggctgcatcaatttccagacttcccgtatttgtgcgttccccaagagacggacccgcaaaacagaatcgttcatcaaaggtttcctgtttcggctgaaaggcccttggcataaagacgatattcaatttttcaggcatgaaaaattcttccattgtcatccgtttcacttgttcattttcaattttctcctgatattcttctatcgcctgtttggccgcttccatcgtttcttcgtctcttcctaattgaaaatactcattcattgcataactcgggcagaactttacggccgggatgccgccattatccgcaaacaattttccggcaagcgctaaaaaatcaaacaggacgatgtcaggaaggtcgtctttgtacagctcttccagctgcggaagcacttcaaccgcttcttccagaaacatcacaaacgcgtcacttttgtttacccgttcttttatcgtcttcgggtccgcctttatgcttgtgcggtataaaacgggaatggcacccgttttggcaacggaagcttcaaattcctcagtcgtagcgaatgtcactttatatccgcgattgacaagttcctcggctacaggaagcgtgggattgacatgaccgtgagcggccacattaataatggcgatgtgtgtttttctcatcttttttcttctccctcattttcgtttatctcggcttctaaagactccagcccgtacatgacactgtttcggatcggctcaatccgaacgggctcaaggtgtgaaaaggcttttacaattcctttcagtgcggcttccgcttcaagtctggcaagcggagcgcctaagcagaagtgtacgccgaatccgaaggaaaggtgcggattcgattggcgatggatatcaaatacgcccgccttctcaaatttgttttcatcacggttggcagatgcaacgtagcagagaacgatctctccgcttttcaagcggcgcccgcgcagttcagtgtcgtgccggaccgtccttctgacaaacggagcgggagcgcgaaaacgcagcgtttcttccactgtttgcgcgatgagagaagggtcctgtctcagctcttcataaaggccgggcgtctctaatatgctgtaaaccgcatttgaaatgagattagtcgttgtttcatttcccgccactaaaagcaggttgcaaaacgggatcagatcttctggcgtgagcttctctccctcttcttcctcttttatcaaaatagaaataatatcttggccgggctgttttcgtttgctttctattattcccgcaaaaaacgccgccagctccgcctcacattggtcacgttcctgctgatttttctccgccgcttcaggactcgcatctttcggcatgctgacgagaatgtccgaccattttttaaactgatccatacgctcggacggaacgcctaataattctgaaatcaccatgaccggcaaagggtaagagagatctttaacgatatcaatccgccctttgttctttgcctgtttcaggagatgatcggtaatgtctttaattctcggctcccattccttcaagacacggggagtgaaagcgcgattgacggcagatctgatttgggtatgtttcggcgggtccatattcagcatggactttgcaatcgagcttttcacatcagtcatgcggcttgagaacgtctctttatcactgatgacttttttgacatcatcgtataaaaacacactccaaaccttcgtttcttcatcaaagtatatagggctttcacgtctcattttttcataccaaggaaaagggttgtatacgtccaggccgttttttcctttcatcagggttctttggatggcttgtctcgtgctcctcagcttactcatgttacatcactcctgattgtttcatatttgaatagttgacgtaccttgaattttatcctagcacatattttcaatttttttctattcataaccttaactattaacataacacaacaaaagtcatgaatccggaggtgaaatttctcccaagaaaacagcagaagcgcacaaaaaacccgagccttcagccaggctcgggagaaatgttcactcattcgtctgcggtttctggtgctgcttttggtcttcaggaggctgcgtatttctttccatatcgtccgtatcagcgcccatgcctttcaggaaagaaaacagcagagtgacggccttgttgatttccgggtcttttaaagcgcggacgatatcaaaataacccgtcttcctgccgctgtctttttcttcgacggcctttgtgacgcccgcattgattttaacgataaacggctcaagctgttttacatcgagcatgccgagaacgccgcttaacagcaggagatttttcagcatattggccgtttccggcgtattcgccttcttcaccaggatatccatcactttgtctccttggccgaagagcccgcgcagaagcgccaaaacgccgcgctcgttcatgtgctgaagaatgtgcagagattccaaaatcgcgtctttatttcgtaaaagagccgtctcgatctcttctaagtccttttttcgtttgtcttcttctgtgacggtctgttttcggatgccgctgattgctttagccattctgctgtttccccctttttacggcgtctcccggaaatacataatcttgacgcgcccatttccgatcaacccggacaccgatctgcggctgcgggtttccgtaacggaaattgattttcggaagcggattaacgccttcttttttcaaaatctccatcttcgctgatgtttctttatatgccggtgtatcggtatccttatccgcatagctgcttgtcaaaaggttaatggcggcgtcttttgaatcgttcatcgggagatagacttgtttgccttttaccctgtctgtgatgacgcatttgactttcacatttccgtacggtgatgtcagacggacaagcgttccgtcttccagccctctttcttcggcgagttcgggcgagacctcaaggaacacactcggtgttttttcggatattccttttgatcggtaagtcagattcccttcgtgaaaatgctcgagcagccgcccgttattcacatggatatcatattcttcatcaaattctttcggctcggtccactgaacgggatatagaatcgctttgccgtctgaaaacggaaacttgtccgtaaataaaagcggtgaatcggttccgtccgctgctaccggccattgcagtgaattgtagccttcgagacgttcgtaagtgacgcctacgtagagcggcgaaagcattgccgcttcttccataatgtctgccggatgttcatagcgccaatcagcgcccagccggttggcgatgtccgtaatgatctgccaatcaggctttgaatcgcccagcggttcaaacacttcgtaaaggcgctgcaccctccgttccgtattcgtaaacgtcccttctttttcaagactcgggcttgccgggagcaccacatcggcgaactcggccgtccgcgagagaaaaatatcctgcacaacgaagaaatcaagcttttcaaaggcggcatgaacatggttgatattggagtcgacaagccccatttcttccccttttacatacatacacttcagttttcccgagtggatgccctcgatcatttcatgatttgtcattccgatttctttcggcaggtctgttccccagccctgttcatactttttgcgggctttttcatccgttactttttcatagccggggaagctgtcaggcatactgccgaaatcactggctccctgcacgttattatggccccgaagcggatatgagcctgcgccgggcttgccgtaatttccggtcacaagaagcatgttggaaatggccgtgctcgtatcacttcctccgatatgctgggtgacccccatcgcccacagtgcgcatacgcttttggcttcatgaatcatccgggccactttaattaaggtatccttgtccacaccggtatgtttttccgcatattccatcgtataaggttcaaggcttttcacgaattcatctaatccgttcactctctccttcagaaatgcagtatccgccaaatcgtgatcaagcagatatttcgatacggcattcagccagacaatatctgatccggcacgcggctggaaaaacacgtcggagcgctcggccatttcatgttttcgcaagtcagcaacgacgagcttctgtccgtgcagcttatgagaacgtttaatgcgtgtggacaggacggggtgagactcagatgtatttgaaccgataatcagcacgagctcagctttttctatatctgtaatcgaccctgaatcaccgccgtatccgaccgttctgaacaatccggccgtggcgggagactggcagtagcgtgagcagttgtcgacattatttgttccgataacggctcttgcaagcttctgcatcacgtatgattcttcattcgtgcatttggaagatgtgataaacgcaagcgcgtccgggccgaaatgttcttttatatcggtaaatttatcagcgatcagctgcagcgcttcatcccattccgcctcccgaaacgagtctccttcccggataagcggtttggtaaggcgcttttcactattgacgaaatcccagccgaatttccctttcacacacgtcgaaattccatttgcgggcgcctcagcctgaggctcgacctttaaaatgtctcttcctttcgtccatatatcaaaactgcagccgacaccgcagtatgtgcatacggttttcgtttttttgattctttcatcccgcatggccgattccatatccgatatggctaaaattgatccgtatccggtttcgacgccttttgtgatatcaatcatcggccgaagcgtctcttggttaatgcctgttaaatacccagcttcgccttccatgcctttttccatcatggcattgcacggacataccgtcgaacaatgtccgcaggaaacacatgatgattcattgatcggcacatcctgatcccaaatgacccgcgggcgtttccgctcccaatcaatgcttaaggtttcggttacctgtacgtcctgacaggcttcgacgcagcgtccgcacaaaatgcactgatcgggatcatatcggtaaaacggatttgattcatctttaggatacggtttttgatcgaacggaatgctttgatgattgattttcatttcctttacggtattatgtatttcgcagctcccattgttgtaatcacagaccgtacagtacaattcatggttgtgcaaaatgttgtccatgccgataacctgcgctttttttacatcggacgaaagcgtatcaatgacatctccgtcctttatttgcgcggaacacgaacgcaccagttccccgttaacattgacgatacaggtatcgcacgtttcaatcggcccgagactcgggtgataacacacgtgcggcacgtcaattgaactattgttcaaaagctgcaaaacggtttggccgtccggcgcttccatttcaaccccattgattgtaactttctttgtatcagccattttctttcccctttctgtacccctctatacatcctctatgattcccaaccggcctttcactaaaacatctcgtttatctcaggaaacatacgggtatgagcggtaaaaaggaggcgttcacatgttgaagaaaaaaacactcgtcacgggattatcggcagtgatgctcacgggatgcgctttcggagcagaagcattttcggatacacagcccgtccatgccgcagccgcttcaaaaacggaaaaccagcgtgcacaagaactggtgaacagcctttaccaatcggcatttaaaggggaaatgccgcaaaatgtgaaaggcctgaaaatcaaccaaagcacaagacaggacgtttacaataaaatcggcgagccggaacaaaaagcagacagccgcaatccatttgatttatacagctggaacatgggaaaccccgggtatggattttcctatcataaaaacggaaaaatctcggaaatacgctattttggaacgggggtcgagcggcgcttaaacctcggcagcgtcacacctgacgtcttaagcaaacaaatcggcagcgctgacaaaatcctgacagtgccagaaacgggcgaaacagattacgtctaccatacggggcagtatgagctccgcttcgtcatcggcagtgatcaaaaagcagatcatgtcaacctaaaagccagataacgcaaaaaagcggcctcccgggccgtttttttcatagacagcttctccgtcgttccttacaatacatgggagtacaaaaaaaggggaacagtgtgaagtgaatagacatccattgacatacggaatatgtaccgtttttatcatcgccctcggtttgctgtccagaaccgcatacatcaccgccctattgcccggcatcataaacgcttatttaggagatgccttgtgggcggccatgatttttacaggattcgggcttttcttacggcacatccggacggaaacagccgcaattttgagcctctcgttttgctgtctgattgaatgcagccagctgtatcacgcgccatggattgacgcgatcagaagcagcacgctcggcgggctgatcctcggctggcaatttgtctggagtgacattttcgcctataccctcggggtatgcgctgccgcacttttagaatgggccgtaaaaagaaaccgccagccctcttcataatcggagcacgccgccgatatgaagggataaggaggtggaagctatggatatccctgcgttatcaatcgcaatgcatcagtcatctctggcgcagaatgtaaatatcgctttaacaaaaacggtcatgcagcatgcacaggctgcggcggaagaaacagtgaaaatgctgccgtcccagcacccgactgccggccattcaattgatgtgaaagtgtaaaaaaagatgccggatgataaccggcgtcttttttttgcccattgtacatacaccgtaccgggcatacaggaataaggtaaacggaaccaacatttgaaaaggaggttttcctcttgtacgatcctttcgatcatgaatacacagccgagagccacgaacgggtgccatatcattatccgcggccgccttattattaccccagaccatatccatactatccgcggccgccttattattaccccagaccatacccatactatccgcggccgtatatcccgttctatccttggtattaatgtttgaaaagaaatgactgcagacaggaggcttcccctgtctgctattcaactttgaccgacaggatatacgggagggcttgaactttctccattaccgctgctttcccgcttttgcttttcacccttcccttcacttcaagcaccgccttattcaattcataggacgtaatcagaattcctttttcctcaagagaagttaaaatatcatgcatgacggctttctcttcaatcctgaaactgacagacaaagaatgcgccgccggtttaaacagaaaatttaacagttcaagcccgattaacgccaaaatcgtgccgctgatgccgatgacatacatacctgccccgatcgtcagcccgatccccgacgtagcccaaatccccgcggccgtcgtaagcccccgcacgacatgccgctgcaaaataatcgtgccggctcctaaaaatccgacgccgctgacgacctgcgccgccacccggctcggatcaaaggacgtatggctgttggataacaaatcaaaaaagccgtatttggaaacgatcatcatcaaggcgctgccgacggccactaaaaaatgcgtcctcaaaccggcttcctttgccctgaattctctctccaatccaataagagccccaagcagacccgcaaccgccagacgaatcacaaaatcaagttccatccgtctctctcctttccttatcttcttacccgcttttataacccaatcatgcggtgtatctttttttaaaatgcaccgactaattgacataaggaggttttatgaaatatattctgtggttttttatattattgttatttagcttatttattttgggaggatataaagcagctgtttctcaccctgatttcccggtgccattattcgctatgcacactaaaacaaaggaatatgaaaaaggaaaatacgtttcaaactatacataccgtttcgcaaaagaagaagaaggtccgagcggtttataccaattggaaatagccgaaaaaggctggaaacttaaagggcaggaaggacttatcaaaacctatgaaaagcgaggagaacgtgtttcactttttttcggtacgggggaaataagcgtcattgaagaatgatccttctcaaaagacaggctgaaatccgcaaacggcatatcttttacgactcccttatctctgcgaatctataaattcagccaatatttcaattaaggcgaacacctttctgatgcaaaaaatgccgccttcaatgagaaaatcattatacaaaaacaaaagcgcaactgaaaaagaataagcacctcataaaaaaagccctctttttaaaaaagagggctgcagaaggaaaacaggtaattatttatctaaagtgtactcactcacattaaaagtaagaatgtttccaaaaacaatatggtcccttctattttgaaaaggccctatattattatagtgcttctcgataacatatctagataagcctattccagaacttttttgatcataccatctgataaaatctttaatctcttccattgaaagatcaaattctttctcaagacctgtggtcattgtaacaagaagaattgcccgattactggcgggctgtttatttggtggttcctcaggattctttggttctccatctttatcctcttcggtttttaccggagtaagagcatgcagatattctaatgcatatccagacggcgttagaccgccaaaaagataaagattgtctccaactgcggctattctggcatcatatctttcaaaaggatagggtttttctacgctaatttcatctttaattggatcatatacttttgttaaaggctcaatcacacttggattttttctaccgccaataatgtaaatcttattattaaggacagctgtcgaagtattttgcaaaggtcctaaaaattttttgcgattccatctatccataacaggatcatattcgtaaatatattcgtttagatcgcttctgatatgtccttgaactacttctttagtttgcccgccaactaaataaatctttccgttaaaaacttcagtttctgttgcatatatattaattgggggcgcttttttaacactccaagttttggataaagtatcaaaagcataatgttgcgaatgagcagcatcggtgtcgaatcccccaatcaaataaattgtatcgttaataacagcggctgatgcatggcaagtcggggtcggaatatcaggtacacgtccccatgtatttgttttagtatcataaacatctacagagctgtaaacatttgctcccttataaccgcccaatacataaatataattacctatcactgctgtgcatgaacctaccctgggtgtgggtatatctaatccttgcgtccatttttgacttatggtgtcaaaactataatttttgttatatttttgattacgtgcacctcccaatacataaatagagttacccacaactgctgattcaaaagcataattaggttcaatcatatcaagtaatcttgtccacttgtcatatttctctgtcaatttattcattcctctcatctttgtgataattccatttatagatggcgatcgtatgacaagagattcatttaactaagcgatccaagatcacttactttcgatcaaagaaatattgaaaaaggcctctggatttaaaagtgatttggttttcacttctcggttattggccaacagtttactaaaaatttagtatataagtgtaatatagaataacacctctcaatgaatccttaatgaagctcataatagcttcaaccaaaggcatttcacattaaagtaaagatcactctcaatccaactgcatctctcaaacagaatgtccggcaatcacctcaaaaaacgaggtgaaatctgtcagtatcccgtcacccgccagctgtttttcttcaaatagcgcgcggttttttccgtgcgggtcaatggccataatcttgcccgcacctgcttttttcgccgctgtgagccccgaaaaggcatcttcaatgaccaagcattcttcaggtctgaggcctaacttttccgatgcgatgagaaaaatatccggcgccggttttccggggaagctcccgtcatcaaacgtgactttgtcaaaatcaaaccactgatccaaatgaaagacgtcaaagtaaaactcgacattttcctttaccgtagccgtagcgatggtcatcggcgtttcagattttttcagatgattcaatacgccggtcagtcccttcgtcagctttaattcgtctttgttttcaaggcataattctctgtagtaagcttctttttcaaaagacagcttcctgatttcttcatttgttaaatcgccggaaataaaatacgtcaggatttcactgtttgttctcccgtgaatgttaacgaaaatgtcttcatcagaaatggttttcggcgcgtattttttcaccatgaaaaaccatgctttttcgtgcagatgcgaatcttgaaacatcgtgccgttgaaatcaaaaataacccctttcatcgaaccgcccgccttttttatttttttgcgattttgacatctacatattgctcgtaatgaatttgaacatctttcatgactttatcatccgtaatcagatagtccatatcgtgcaagttatagaacacgtaaaaatcttcccggttaaattttttattatccgccagcaaaaatttcgtccgcgaattattcagcgcgatttggtgagcttccccttcttcaatgctgtaagaagaaatctcatcattatgtatgccgttggcgctgatgaaagccttcgtaaaattgaatttctgcagattgccgttcacgatggggccgacgaaggcaccggtattttttcggaagtcgccgccaatcaggatggtatccgcagtgtcgccatgtttcaaaatatcaaatacgggatagttgtttgtgataatcctgattcgcttatgcagcaggtgtttcgctaaaagttcaatcgtcgtgccgggccctaaaaaaacggtatcgccgtcatttacataggaagctgcgagttccgcgatcttccccttctcctccatttgaacaccgagtttttcattatgcgataattcgtgatcaatggaataagatatgctctgtgcgcctccgtgaatacgtacgatttttccggccttatccagctcgtccagatctcttctcactgtcatatcagaaacttccagttcatcgataatatcactcaccgtaataaacccccgcgagtttacgatatcgatgatttttaaaagtcgctctttttttaacatgttcaatcatcccctcaactttacacacaatctaacatactgcggcaatccggtcaacaaaaataaacattaacaaacaacataatcaacatgtaaaacaacgaaaaacttatataacctctataaacacagatgttatttctttatgaagctattgacaacaaaaatatatgcgtttactattaaacaaaagacaacaattacaaacattaacaaactccaattcacacattggcgaaggaggattcagtaatgctcaaattacctcatgactttattttcggcggggcgactgcggcatatcaagcggaaggcgccacaaaagaaggcggcaaaggccctgtggcctgggatgaatttcttgaaaaacagggaagattcagccctgatccggcaagtgatttttaccgccagtttccggaagatattaaactatgtgaaaaattcggaataaacggcatccgcctttctatagcctggacgagaattttccctgacggcacgggcaaaatcaatcaggaaggtgttgattactatcatcgtattttctcagagtgccataaacgcaacgtcaccccttttgtcacgctgcatcatttcgatacaccgaaaggattatttgatcagggagatttcctcaaccgcgctgcaatagaagcgttcgtcagctatgcggagttttgctttaaagaattcagcgaaatcagatattggagcacgtttaacgaaatttatcccacagccaccaaccagtatttactcggggttttcccgccatctgttaaaagtgatatcacaaaagtcattcaatgcctccatcacatgatggtagcgcatgcgatgaccgtcaacctttttaaagacggcggttatccgggagaaatcggggtcgtccactcattggaaacaaaatatcccgccagcggcacagaagaagaccgccacgcctgttttctggatgacgcgttatcagtgagattcctcctcgatgccacctaccttggctattattctgaggaaaccatgcgtgctctggatgaaatctgtgaggcaaacggcgcttcatacgagttttcagacagtgactttgacgtgatgaaaaaagcctcaacgcgcaatgattatctcggcatcaatcattatcaatgccatttcgtcaaagcgtacgacggagaaaccgttattcaccataacggaacgggcgataagggcacttcggtctataaagtaaaaggaatcggcgaacgaatttacaaagaaggcctgaagcggaccgattgggactggctcatttaccctgaaggcatgtatgacatgctgatgcgcatcaaacgggactatccgcaatataacaaaatttacattaccgaaaacggcatgggctataaagatgagtttgaagacggcatcattatggataaggcaagaatcgactatttaaaagtatatttagaagccgtcagtaaagcgattaccgacggagtcaatgtaaaggggtacttcttatggtccttaatggatttattttcatggaccaacggctacaacaaacgttacggtcttttttacgtcgacttcgacacccaaaaacggtatccgaaagaatcggcctactggtacaaacttgtaagtgaaacaaaaacaatcatttaacgatcatacatgatgaaaagaatctctttccatcatgtgtgccgtctttaggaggtttttttcatgacaaaggaagaattgcagatgctcggttttgaaatcgtcgcctatgccggcgacgccaggagcactttattgaaagtcctgaaagaagtccgtgccggaaacttcgaaaacacggaagcagcattgaaaagcgccgatgaaaatttaaccctcgcccacaatgcgcaaacgaaaatgttagctgaagaagctgacggcaaggacatggaattagggtttattttcgttcacggccaggaccacttgatgacaacccttttgctccgtgatcttattcaggattttatagaactctaccgaagccgccgataaggagtggaaaaatgaacggtatcatcaagcaaatcgaaaagggaaaaccgtttttcgaaaaaatctcaagaaacatttatttaggcgcgatccgcgacggcttcttaactgccatgcctgttattttattcgccagcattttcatcctcaccgccgctgtgccggaagtgttgggtttcacttggcctaaaagtgtttctgaatggctttggaaagtttataactattcaatgggcgccctcggtctgatcgttgcggcaacaagtgcgaaatgcctgagtgaatcaatgaaccgaaaaatgccgaaaaacaaagggatcaaccccgtttcagcgatgcttgcttcagtcgtcgggtttctcattttaagcgtcactcaaatcgacggcgggttctccgcggaatatctcggcacaaaaggtcttttagccgcttttgtatccgctttcataacggtgaacgtttacagattctgcgtgctgaaaaatattacgattaaaatgcctaaagaagtaccgggtaccatttcacaaacatttaaagatgtttttccgttcgctttttccgttttggccatggtgatcgttgatttattgatcaggaatacgctgaatgtatcgtttgcggaggctctctcctctctcttatcgccattttttaccgccgcagacggttatctcgggatttgtgtcatttggggaatgatggcgctgttctggtttgtcggcgttcacgggccttctattgtagagccggccatcgcagctattatttacgcaaatgtggaggcgaaccttcagcttcataatgccggcgagcaggcgtccaacgtgctgaccgtcggactcgggaacttcgtcggcacaatgggaggaaccggcgcaacccttgttgttccgtttatctttctgcttttcgcgaaatccaagcaattgaaagcagtcggaaaagcatccgcggttccggtgtctttcgcagtaaacgaacctcttctctttgctgcgccgatcattttaaatccttattttttcattccgtttgttgtaacgccgatggtgaatgtctgtctgtttaaatttttcgtggatgtcatcggaatgaacagttttatgtatgttcttccgtgggccaccccggcgcccgccggcttgattctcggaaccggcatggggctctcggcttttgttctgacggctgtattaattattgtcgatttcctgatatacctgccattctgtaaagcttatgacaaagtattagcggcggaagaagcccaacataccgaacctgaaaccgcgccgcaaaaatcccgggagatacagcccgtaatggccggcgcctcagaagacgcggccaccgtcatcagcacaaatcttcaggaatcctcatccgccttggaacacggcaccaatgtgttagtgctgtgcgccggagcgggaacgagcgctatgcttgcgaacgcactgaccgaaggagccgaagaatacaacgtgccgatcaccgcctcagcaggcgcctacggatcccattacgacatcatgaaagacttcgatatgatcattttggctccgcaagtcggctcttattatgatgacattaaagaagatgcggaccgcctgcatgtgaaactcgtcgcaacgaaaggagcggaatatatcagcctcaccagaaattcacaaaaagccattcagttcatactggagcatacctcaaaatagaatcggaggtttaccatggatgccaaacttttgaaatcaagattcgaagacattttcaagagaagtaacggagaactgtttttcgcacccggccggatcaacctgatcggggaacatacggattatataggcggtcacgttcttccatgcgcgatcacgatcggaacatatgccgtatgcgcaaaacgcgaagatcaccagatccggttatactcagaaaactttcctgacagcggcattgtctgccttgatctttccgccactgcatacaaaaaagaagacggctgggccaattatccgaaggggatggtccattaccttcttgaagccggcggccaaatagacagcggaatggatattctttttcacggtacgattccaaacggagccggtttaagctcctctgcttccattgaaatgttaaccggttccattttaagaaagttattcagcctggatgtttccgatactgaactggcgcttatcggaaaaagagtcgaaaatgaatttatcggcgtgaattcagggattatggatcaattcgcagtgcaaaaaggcaaaaagaacatggccattctgttaaactgcgataagcttgagcacgaaatgattccggctgcttttaacggatataaaatcgtcattatgaatacgaacaagcgccgggagctggcggcttcaaagtataatgaacgccgcagcgaatgcgacgcggctctcacggaactgcggcaatatcaaaatatcgcatcacttgcggaattgacgggagaagaattcaacgaactcgaacctcttctctcccgtgaaactttgcgtaaaagagcccggcacgcggtcaatgaaaacgagcggaccctctcagcggcggaagctctcaaatcgaatgatttgaaaacgttcggggagctgatgaatgcgtcgcaccgttcgttacgtgatgactacgaagtgaccggtgacgaattagacgcgctggctgaagcagcctggaaagaaggagcactcggagcgcggatgacgggcgcggggttcggcggctgcgccatagccattgtggaaagtgaagaaaccgccggctttatccgggccgtttcatctcactaccgcagcaggacaggtcttgaagcttctttctacatcgcggatataagcgatggcgcggctgaatggagggaaaaataaatcatggcgattctcgttctcggcggagccggctatatcggttctcatgcggttgatcaattagtaaacaaaggatttgaaacgatagctgtggataatctccagacaggccaccggaaagccgttcatgaaaaagccgttttttaccatggagatatccgtgacaaaccgtttcttcgctctgtatttgcgaaggagaacgtaacaggcgttctccattttgccgctcaatcccttgtcggcgaatcaatgaaagaccctctttcatatttcaataataatgtgtacggtacgcaaattacgctggaggtcatgcaggaattcgaagtgaaacacattgtgttttcttcatccgccgctgtttacggcgaacctgaaaaagcgcccatcacagaagacatgccggaaaagccggaaagcgcatacggcgaatcaaaactcatggcagaaaaaatgctgaagtggtgcgataccgcttgcggcataaaatatgtctcgcttcggtattttaacgttgccggcgcgaaaacggacggttccatcggagaagatcatcatccggaaacccaccttatccctatccttttacaaaccgcgctcggtcagcgcgaggaggttttgatattcggcactgactatgatacaaaagacggcacgtgcatccgcgattatgttcatgtttctgatttaatcgatgcccatattctcgctctggaatatttgcaaaacggcggagacagcggcattttcaatttaggatcaagcagcgggttttccgtatcagaaatggcggaagcggcccggcaagtgaccgaaagagacataaaagtaagagcgtccgcaagaagacccggtgatccaagcgccctcatcgcttccagcgataaagcgcggaacattctcggctggaatccgaaacaaacggacatatcggaaatcattgcgtcagcatggaattggcatcggcatcatcctaacggatacaaggacaaatgaaatggaggcggcggtcattgacgtttttgaatcagtggcagggtttctgaaagaaagcactgtcttaggcgacataaatgaaacagatgtgatttatacaagaaacagacttctcgatctgctcggactgacggattatgcagaaccgaaacgtatcaagaaacaaaacaggcttcactatttggacgaaatggtgaaagacgcggtaaaacggtcaatcataaacgatacgccggctgaaagagacatgctgggaagcagaatcatggacgtaatcacaccggccccttctctgatcaatgacgcattcagcgaattgttatcagattgcccgaaaaaagcaacagattatttttatagattgagtcaaaacaacgactatattaagacgcgggccattcgaaaaaatatcgtgtaccgctcaataacaccttttggggaattggacatcaccattaatctatcaaaaccggaaaaagaccctaaagacatcgccgcggtaaaaaacagtccggaaaaccggtatccgaaatgtctgctctgtatggaaaacgaggggtatgccggaacaccgcatcaccccgcccgttcaaaccaccgcatcatcaggcttgacttagcgggagaacagtggggttttcaatactctccttatgcgtattacagcgagcatgccatctttctttcaagcgtgcacaagccgatgaacatcagccgcgaaagcttcagaaggcttctggccattacggaaattttccctcattatttcgcgggatcaaacgcagacttgccgatcgtaggaggttccattctttcacacgatcattatcaaggcggcgcccatgagtttcccatggcaaaagcgggttccctctacccttttcatatgcgtcattttccagacgttcaggccgaagccgtgaagtggccggtatcagtgatccgccttcgcgcaaaagatccggatttgctgacagatgccgctgcgtatgtttttgaaaagtggcgggaatattcagacgaaaccgtcagcatcatcgcgaagacaaatgaaccccataataccgtcaccccgattgccagacgcaggggaacggattttgaaatcgatctcgctctcagaaacaaccgcacctccgaagattatccggatggcatttttcacccgcatcaagacgttcatcacatcaaaaaagaaaatatcggtctgattgaagtgatggggctcgccgttttacctccccgtctgaaagatgagctggcagaagtgaaaaagtatttactgaatgaacatcatgacatcaaggacattcatcttccgtgggctgaaaacatcaaagcggataaagacgtgacaccggaaaatgcagccgctgttttacaaagagaaaccgcgaatgtatttttacgcgcgctgaccgatgcaggcgtttttaaaatgacacccgaaggaattcaggcgtttcagcgtttcacgacgttattggagaatgacagctgaaacattcagagtgaaatcaatcaacaatcttttttatcaggaggtattgtgatgttcaaaaaccgattgaaacgtgtatttgtaaacgcaatctgtctttctctcattttcaccgcttttacatttcttgagaagtctcctaaagcaaaagcggatgccccgtttgcctatggcgctgatataggatggctgaaacaaatggaggatgaaggtgtgcgctggctggatgacggcgggaaacagaaagatgccttgcagattcttaaagatcacggaataaatgccgtgagactgagagtgtttgtgaatccgccaagcagctattattggctgaaagacggcacaacatggacgatgctcggctatagtgacaaagcgggcgtacttgcggcggccaaaagggcaaaagcgttaggaatgaaagtaatggttgacttccattacagtgatgtgttcgctgatcccggccaccagatcaagccgaaccaatggaccggctattcaaacagccagctgcaggcagccgtgtataaccatacgtacgatgtcatgaaagaacttaaaaatcacggcatctctcctgattgggtgcaagtaggaaatgaaatgaattcaggaattttactgcccgacggcagcacgagcgatttcagcaaattgaccggcttactgaacaaaggctatgacgccgtgaaatccgtcagcccggccaccaaggtaatcagccatttagcacacggcacggacaacagcctattcagatggtggtttgatcaattctttaaaaacggagggaaaaccgacatcatcggcgtttcgttctatccctattgggaaggtaagccgtactgggagctcaccggccatttatcatctaatttgaatgacatcgcctcacgctacaacaaggaagtcatggtggttgaactgggcggagatgaaaataatccgaaagattcctactggaccataaaagacaccataaaactggtgaaagccgttccgaacggcaaaggaaccggcgtattttactgggaacccgaagctcactccagcgttctgtcagatgcgtatccattaggcgcaaccgcaaaagtgtctaaaaacgtcttgaaatacacaaccgcaattgacgctttttatgatgccgcaacaggaaaatgattgatgcaattctaaagcaggctcttttcgcagcctgcttttttgtaaggctgcagagttagcctgttatgaagagctaataacgaatacggaaagaaacatactcgaaaaaccacatttcggttaaaaataggatacttcttctgttccccctccttcttatttctgcgcactatctctcagttcctaaataataactttacgattgttgaaaaagaaacaaacattttataatattgtgtaagcaccaccgagcaggaggacgggtcatggacaaaaaagaacagctcctcacggatttcagggacttttttaacaagatggtgtggctgaataggctgaagatggaagaaagccttaaggggcataaaccttctgaagtgcattgcatcgaattcatcgaaaaaattgaagacgccaatgtgacaaaacttgcggagtccctttatatgacaagaggcgctataagtaaattaacgaagaagcttatcaataaaggccttatcgaaagctatcagaagccgcttaataagaaagaaatctatttcaggcttaccgagcaaggaaaagtcatttataaaattcacgaggaattgcacaaagagtttcaagaacgggacaaaatcgtgtttgaacaagtaactgatgaacaatttgacacgatgctgagcttcgtggaaacatacagcaggcatttggattcagaaataaagaaacttggtgcagacatgaaatcggaataaaaccataggcagccctgctccatgaaaacgggctgcctttttatatccctcttattgttgacaaagaaacaaaatcactctattattttgttgacaaggaaacaaatacggcgattttgagaggagaataatatgtcaacacataaaagaaaggaacttcggctgccaaaagaagttctcacagccgcctgggctattgcactgggagcaattgctccaatgcttgactctacgatggtaaacatcgccatcgacaaactgaccaaagacttcaacacgacattggataccattcagtggtccgttacaggctatatgttagcacttgcgattgcagtacccgtatccggctggcttatgaataaatataacggtaagaaaatcttcatcggctcagtcatcgcctttggtgtcatttctgtttttgcgggaatgagccgtgacgtttccagcttcatcttcttccgtttgcttcaaggattcagcgccggcattatcactccgcttatgtcaacactcttggttaaaacggcaggtccggaaaacctgggaaaagtgatggcaatcgtcagcacccctatgatcttcggcccgatcttaggacctgtcatcggaggcttcatcgtccaagtcgcttcatggcattggattttttacatcaacgtgttcatcgttttggttgccgcaccgcttatgatgaaaaccattccagactttgaaccattcaacaaagatcgtaaactcgatattttcgggattatcaatttgtcattaatgagcgcggcattgatgtacggtattacgaaagcggcggatcatgcatcatttaacaatagcgacaccattttatgggcgggcatcggtcttgtttcagcagtcatttatcttgtatataatctgatcaagaaaaaccaaaccgtgctgcctatgaatttgtttgcaaacaagagcttcttagcatcttcgatcgggttgttcttagcgaatgttgccatcatggggccgatgttaatacttccgctgttttttcaagacattcgtcatttcacggcagtcggagcagcactcgctttaatccctcaaggagtcggaatgctcgtgactcgtccgctgatcggaaaaatgattgataagatcggtgcgaaatacgtggttacggtcagtcttgttctttcgctgatcggatctatcccgcttatttttatcaccgataacacaagtatgatttggatttccgtcgtattatttatccgcggcaccagttttggaggaattatgctcccattaatgagtgacgcttatacaggtcttgacagcaaacagcttccggaagcaggtgtcggtattcatatgattgaaaacctcggttccagctttgggtcagctgtgatcgcaaccgttaccgcaactgtcatacaaggattgcagccaacgattccgaacagtttaaaaggctaccatgccggattcttagtatccgtcatcatccttgcggccatcttcattccaagtctgttccttacccataaaaagactgcgatataaagaacttttcaaagtaaaaaacccttgcgcagcaagggttttaatgaatgaaactgatgattgttgccggcagagtcagccaacaacatacaaagccttttactcattcacattgcttttcattaaccattctacttccgttaattcttgtttttgaacgtcttttgtgtgctttttcgtaaaatggactttaacagcttcttcgttttcccaaatctcccaaagcataattttgcgttctgatggttcaagcggatgagcatggaactgaatacagccttcttctttgttcgtttcttcctcaagttttttgaattccttcattatttcattaaggtctttatcactgatgatttttaagcatgccgttatgtaatgcatcgaaactccccctcttcccatcattttatggctttacattataacatcgaaacccgcataccgcattctcaacatataaaaaaccgtccataaaaaatgaacggcaatgtttatttaagatcatgaagagcgacttttgcagcctcagcgataagagcattatgataatcggcatcttctgtaaatcggtttgacaggattgccaaaacaatcggagctctgtcaggcggccaaacgatggcaatgtcgtttcgcgtcccgtaacttccggctccggatttatcgccgacttcccatcctgcaggagcgcctgcccgaatcagttcatcgccggtagcgttgccccgcatccaatccgttaagatcgtgcgcttgtcagtcgtgagagtgttacccaaagtgaacgctttaagatcggttgccagtgcctttgctgtgcttgtgtcacgacgatccccgggaatcgcagagtttagatccgtctcgaatcgatccgctttcgttacatgatccccaatctgtttcagtgatttttcgaaacctttagggccgccaagctgctgcagcaataggttccccgcagtattatcgctgtaacggacagcggcttctgagatttctttcaggctcatgcctgtatccaggtgtttttctgtgattggagaatatgtaactaaatcgtctttgctgtagcggatgatggcattaagtttttcatttgagcttttcttcagaacagcagctgcagccagaactttataggttgatgcgtaagcaaaccgttcattcggccgataggcgattgtcttgtttgaccccgtatcaatcgcataaaccccaagcctggcatcaaattttttctcaagctgaacaaatttttgattcgttatacagcttgtcatttttgtgttttctatggattttgcttcagcgtgcgtagagccgaataaagggctgaaaccggtaaagcttaaacataaaagcccaatgcatattccaacttgtattcccgctttatttttcacatccagacctcctcattataatgtttttgtatacatcttctaattaacattacaaacaggatgaaagtcaatatatttcctgtgaatgattaaatcctgcattctgattcctccccttattaaatgcgccgcccttgccgcgtctgaatgtttgcatgtccgcttcgtgttcattatctatttgttatccctccgtgcaaataaaaacggacaccaatcagagcatagtgagctgtgcaatgatcagtgtccgcaggctttccgtcttggatctatatatgtttctcttgcagactataaaaatcataaggtaagttaacaaacgcattaccttaatctcgcggtcaaaattatatcattttatatatttcaataagattattatctggatctctgaaatgagcaactcgtgcacgccattcctgacgatcatgtggttcattgacgcatgtaatcccttgcttgtgcaaatagtcatacgttttatcaacatcttctaccttaaattgaagcaaaaatctcgattgcgaatctccgtctaaagattttctttcttctccaactatttcagccatattttcttgagataaaagctctattttcgtttctccattatcgaaaagtgcatattccatttccttctctaaccaacttattggaagtcctaatgaatctttataaaactcgacgctttttttaaagtcattaaccaatagtctaatttgcagcagtttcatattgaacgcctcctatcattttactggccattcatttaatcatacaatagggacctgacagcattatgtcaagtttccacaaaaaaatttcccatactgcacccaaatttcggatggaaagccttcgaagattcatgaaactgcgtttgatcaattcacattcttagtttgaattctcctcctctccaccgtggaggctccggccgtgtaagtcgcgcacccgtaaacatccggcccccgctcccataagtaacacaactgataaataattgactgagtcgttttttcaccgtcatcgcttcccctgttttttatattctgcgatttccttaggggtagccttccggactccgtctgtgtctgtcctgtttgccacttgagcgccttccatgttttttatctcgctgacgactcccaaatgctctaaatacacatgatcaccaatcttgaaacgattcagtttggcccgctcctcggtcatgctcctgtattcagtcgcggctttcatttttaattcagccagacacatttgacaaagtgttactgttacagaattgccgttaaaatcagtaaacgaaaccgatctgacagattccttttccgggtgcatcgtacatgttttcttcataggtgaaggccgtgtaaatttaatcattccgcttcctcctcaaaaaagtcttttcgtccctctgacataactcggatgaatgggaagttccgtacccccgcattcgaactgtcacaacacatggagattgcctttccttcgccgtctgacggattttcatccatcctgcatagctgtaagcctatattcctttatattcccaatgcccgccgcacttccctgttatgatgaagtttttaaagctattgaccagttgcccaggttgattccatgcggaaagcagtttgggccgccgtatcctaattcattcgggtaaatttcagccctctaatatgtgtgtgtatgctttttaaaggaagtgcgtcacatgatgttctaacaaccgattcaacctaaagctaactctaccccaattcccgatcataaaataagtaaatttacccagaacaaattaatcattttgcactttcaaaatacttatttggcttttccttcattcttccatggtaatatcttgttgaagtatttcgcatgaaaggatatggtcatgaaagttttcgaagcaaccaccctcctcgccgccgccaaacagcgtgcgggtgaatataaaaaactgcgcggtcagatggtcaacctaaaaaaagcgtttcaaggtatggctgatcttggtgacaatgatttctcaggccggggcgctgacaatatcaaagcctttttccaggatcacgccggcgtcacagacagctggcttgatctgatcgatatgaaaatcgcatttctcacaagccttcccggcaaagtcgaagacgcaggtctttccgaatctcatgtagaagaatcttttctggagcacgagctcacccatgccctcagtaaatcaaaggcgattatggaagcgcagaaaaaagacatgcgctccatcctcggtgagatcgaagacatcatctcgctcgaattgttttcaaccgaaagcacagatcaaaagctttcttcagctgacaaaaaaagaagcgaaaccatacataaactcggcaagcttgatcacgatctaacgaaagaatacgcagaaaccgaagcgaacgaacagtttatccaagccgactttcagcagctccaaaacgccacaggcaaaggaaaaagcgccacgccgcttcactacaacgccaaagcgtaccgtgaaagcgacatccataagaaaaaaggcgatatcgcaagacattcggatgcttatttgacgattaaaaaggaagaagcgaaagagcgtgaaatcaaggatctgaagaaaaagctggctgatggtgtcaccgatccggatgagtatttggaaatcgcaaagaagatcggctatgaaaaccttgaacccgctcaggtggaatatgtaatgcagcttgaacaagcaaaacagcttgaagaagtcggagaaacggcttgggatatcgtcaaaggaataggcgtcggcctttatgatgtgggaaaagacaccataaccggcgtcaaagatctggctgtcggcgcatgggatttttaccatctctccgatgaacaaaaagtcgctaaaaccatatcggctgtattgaacacgccctcctacgcaaaaatcatatggacaaacctggcggattcgtggaatgataaaatggttaacggggatgcgtattcaagatcccattacatcacttacgccatcgggagcatcgtcgggctcaaaggttccggctcagctgtaaaagtatcaagcaagctcgcgaaaacaggcgccgccaaagtggataacgtcttggaagccggtgaaaaagcagctgcaaaacatgtaaaaaccgggattgaaaaaggaaaaaattatatcaattccgtttcgaaaaataagtaccaacccgcgcttgccggaatagcacaggatattgaaaatactcacaatgtgaagaatactcctttgttgaaaagtattattgaagatcagaaagagagtgtgctcagtaaatctgtgacttctgacaataacggcatacatagtgttaaacaaggagacagcagtcctctcgcaccaggcggtggcttagctgctcacgaagcaaaaggcggacaccttctagaaaggcatgttgggaagactgatgaagagttattacagaggctacagataaacaagaagatacgtgcctcttctagtttcactgataggccaactgcagaaagagtcgctaatgaaacattaactaaacataaaaaggaaattgaagagtggttaaaaagtgatgttaacgatccattaccgttaccttatagaggaaccgaagttataggtagaggagttcgtaaaggttcaaatgaagttaaagatatgactaatgctagaatagtattaaagaaaaataaagatggtagctttatactaacaggctacccaacgaggtgatatataatgattgaaattaaagtttctgatcctgtatttagatttctcggcggacattttcaccaagatatagagtctccggaaaatgcacttgatgaatatttaaatgaagcatcacaaaaactaaaagaaagagatttaatagcactaactgagtttgtaaatagtgattattcagaagaagacaagaatgaatttatagaggaagcagcggatggtatatactttcctgaagatgatataactccattagaatggcttaagcaagtcactgaacaaattaaaaagcatcttaaacaacatagttagaaaaagagccctcttttaagaagggcttcttttattaattcaatttcgctttcgtttttggtccgcaaattccgtctggcttcaaaccatacatgagctgaatcgtactgaatcgttcagccgcatttactgatgtaagtgaatttaaataaattgcaaaaaaaccctcctcatcttgagaagggctctgacttatacttctttttctctaaatcagtccgaagcaaaaaactgatgccgctcaacttttcaatcgaagtgcttcagcgggttctccaactatttgcccctatgcttttcttttgctttttgttttctgattaaatattcttgttcctttattttttctctttgttttttcttttcttttttcaagctcctgttttattgcattttgcgccttagttgatatcccgatatttttcatctctttagaagcttgtcattgcaatctttttggatttaatttcttagattttgctttaacacaaccccttcttgttcagtgtgggagagagtctgtaaaaaaggaaagagtctccgcttattttaacaacacttcaagttttgctttggttcaagcgcataaattccatcagcttttaatccattcaccaattgaaatcgaattactgcattcgctgttttcgctccatatgctccatcaatcccgaagttcttccgctttaataaagggccgacagcgccgttcgaatctgttttacgctctcccctcgggttttaatgggcttttgacttaaaaaaccggaaagcaaggggaagtatgatttcttgccttaggatggagggccccctgtatcacttctttatcatcgacggcaaaatgatatctagtcgattcactgctaccggtcatataactgatttcattagcggctgcatgcgtcatttcctgtgctgtgaatgatttccagattttcgctgtatttttcatacaaaactaaatattccgtttttcaaatacaaaaaaacagcaggattaaccagctgctgatcgttatcactttagccgttcagtgatacggaatttctgtatttctctgtaatgaacaggtttcggcaaagaccgccgccttaaaggcgatgttcacctcccttgaagtatacagcgaatgtacttcaaaatcggcccaaaaaagcagttccgtccccaattcgtccccaactcgatgaatgatgacaaaatcaataaataagcaaagtaaaaaacccttgcaacgcaagggttttggctatgattccgactgggctcgaaccagcgacctctaccctgtcaaggtagcgctctcccagctgagctacggaatcatgatatgtatgtgttgctgggtatgttgttgtctctctgacatttataattatatatcctgatttctcattcgtcaacactttttttatctaaaataaaaaagggcgcgtcgcaaaattgacggcacccttttcgtttatgatctcacttgggcgggggttatttttttcaatgcctgttcgaagtcgcgttctaaatcttcggcgttttcgactccgacgctcaggcgcagaaggccgtctgtgatgccgcgtttttccctctctgatttcggcatggcggcatgcgacatggctgcagggtatgagagaatggactcgacagcgccgaggctgacggcaaataccggaagcgatacgttttcgaccagctttttgacggcttctttgctttccaattcaaaggacaggacggcgcccgctccgctcgcttgacgtttatgggtatcggctcccgggtgtccggcaaggccgggatagtaaacgtttttgattgcgggatgcccgtcaaaataggcagccagccgctcagccgtccggctcgctttttccagtctgacctgcaatgtttttaagcctctcaatacgagccagcagtcctgaacaccgagcaccgctccaaacgagttttgcagcttatacagctgattgccgagctcttcatcttttacggcggcaaggcctgacagcacgtcactgtggccgcttaaaaatttcgtcgcgctgtgaagcacgatatctacaccgagatcaagcggacgctgcagagcaggcgtcatgaatgtattgtcaaggtatgtcagacagccgtgttcctttgccagtttgacgacgcccttaatatccgtgatgccgagcgtcgggtttgacggtgtttccatataaatggctttcgtgttcggccggatggcgcaggcgaccgcttctgtgtccgtcatatcgacaaaggtatgttcgattccgaaacgggacagaacctcagtcaccatgcggaatgttccgccgtacacatcctccgtgacgagaacatggtcgccttgggataagagcagaaacgccgtcgaaatcgccgccataccggagctgaaagcaaaacctctcgttccgccttcaagacctgcgatcgtttcttcaagcgctgttcttgtcggtgtgcctgatcggctgtagtcatatgtcccgaattcttcaaatgaagactgatggaatgtggaagcatgctggatcgggacgctgacggctccggtggctccgtctgttttaaatggattgtgcacgagctgggtttccagcgtccaattgtgattactcatatgacacggccccctcttttacttgctgtaatgcctgctttacatcccgcttcaaatcttctgcatgttcaatgcccactgaaaaacgcagcagacggttgcagacgccgtttgcgatacggatatcttccggaatgtccatgtgcgtctgtgtcgcggggtatgtaataaaactttccaccccgccgagactttctgcgaaacagatcgttttcagcgcctttaaaaacggattgacccattcttctttttgcagccggaaagacagcattccgccttttccgggatataacacgtcggcgatttcctcttcctgttctaaaaattctgcaagttcaagggcgttttcttcatgacggcgcattctgagtccgagtgttttcatccctctcattaaaagccacgaatcaaacggcgggagaacggcgccgatcgcattttggtgattaaacatgatgtcgccgagctcttcatccttaacgacagccagaccggcaaggaggtcattgtgccccgctaaatattttgtggcgctgtgaatgacgatgtccgctcccagttcaagcggacgctggatgaccggggtataaaacgtattatccacaatcaaaagcaggccggcttctttcgtaatccgggcgattttttcaatgtccgcctcctgcattaacgggtttgtcggtgtttcaacaaatagcgctttcgtgttttccgttattttggagcgtaaacagtcttcatcgctgaaatcatcgtaaataaagcttaagccgtattttctccattcgttttcaaacaaacggtacgtgcctccatataaatcggaggatacaatcaattcatccccgcttttaaataaagccataatggtttgaatggctgccattcccgagctgaaagcaaatcctctcgcaccgttttccaacacggcgatggcgtcttcgacgagctggcgtgtcgggtttttcgtgcgcacgtaatcaaaacctgtagattctcctattcctctatggcggtaagcggtggacagataaatcggcggactgaccgttcccgttgcttcttcgcttctatttccgatttgggctaattttgtttcaacatgctgcgtcatcagtaagcaccatcctttttcaaaaataaaaaagccccctcttcataagaagaaggagcttttctcttcctcttatcttccaagcgtgaatcgcttgctggatttagcaccttggcactttgccttcccgcggcaaagcaaaccggttgctgaggtttcaaagggccagtccctccacctctcgtgataagaatattgttttgtattttctgattgttctatattaacgcactataaaatagatttcaacaactttttatttatctgaactctcgcaagaagtgcatctgaagaaagaaatttctaataattcatggtacaataggaaaaaaccatcaagacaagaagcggcctggaggaatgcgaagtggcatcaaaaaacggaatcattcatgagaaaacacttttctcccatgagcttgaagaggaaatgaccgttttggtctacctgcccgccaccttctcccccctgtataaatatcatacggtcatcgctcaggacggccatgattatttcagattagggagaatcgggcgtcaggcggaagagcttatgtcaaaaggggaaattgaccgctgcatcattatcggcgtcccttataaaaatgtgcgggagcgaagaaacacataccatccagaaggctctaagttcgcctcatataagcggtttatcgccaatgagctcgttccttttatcgacaaagaatacccgacttatcaagtcggatacggccgcaccatgatcggggattccctcggcggaaccgtttcgctcatgacggcgattgactatccgaatatgtttggaaacgtcatcatgcagtctccgtatgttgacgggcacgtgctggatgccgtccggcagtcggaggatctcaaacagatttccgtttatcatcaaatcggagaaaaagaaaccggcgttcacacgacggacggccaggttcttgatttcaccgcgccgaacgaagagctcaaacagctgctggaaagcaaacagtctgaatacacgtatgaaaccttcgacggggatcataaatggacctactggcagccgctcatcacgccggcgctgaaaaaaatgctgtaaccattcatttaaggagggaactttcatgaaatacggtattgttttatttccatcaaaaaaattacaggatctcgcaaattcgtaccggaaacgctacgacccgagctacgcgctcattccgccgcatctgacggtaagagatccgtttgaagcgacagaacaggaaatcgagcaggtcgtatcacagctgagacagacggcgaaagagtcgcatccgctcgttctgaaaatcacaaaatacagctcgttttctcctgtgaataatgtgatatatatgaaagcagagccgacggaggaattaaaatctctgagtgagaaatgctactcaggagcattatccggcgagccggaatacagcttcgttccgcatgtcacggtcggccagaagctgtcgtcagatgaacattccgacgtactcggacagctgaaaatgcaagacatttcccacgaagaagtcatcgaccgttttcacctgctctatcagctggataacggctcatggactgtgtacgaaacatttttattaggcggaggagaataactgcttggaatccatcatcgtaaaaactgaaaaacagctgaacgacgcttttttcgtcagaaaagaggtctttgttaaagaacagcacgttccggaagaagaagagattgatcaattcgaagacacgtcagagcatatagtcatatatgacggcggccagccggtcggagccggcagatggcgcttgaaagacgggcatggaaaattagagcgcatctgcgtaatgaaaagccatcgttctttaggcgtcggagccatcataatgcaggcgcttgaaaaagcggcggcagccaagggcgccggcagctttatcttacatgcgcagacgcaggcggtcccgttttacgaaaaacaaggataccgcgtcacatccggcgaagaatttctcgatgcgggcatcccccatctggaaatgataaaggaatacaaacaataaaaacaaaagcactcctgttgatatggcaggagtgctttttttatgaaaacaataccgtttcatgaattttattgcattttatggaaggttaatgtatgtttagtatacgaagtattacaattcatacaaaaaatacaattcatatttcggagggataaacatgacggcaccaaaaggaaaacacatattcgggactgttaaagtgggcacaaaaggacagattgtcattcctaaagaagcaagagatgttttcgatataaatccgggggattcactgcttatgcttggggatgaccagcaaggtatcgcacttgttaaacaagaactctttttcgagtttgcaaaagatattttaaacgctaagcaaatcgacgcagatagcgaggatgagtaaatgcacgcgattgagctgaagcaattaacgaaacattataaagaaaccgccgccgttgaccgtcttgagttctcagttgagaaaggggaatttttcgctttactcggtgagaacggagccggaaaaacgacattaatcaatatgctttgcggactcctttctccggatgaaggtgatgcatcagtgcttggacacagtatttcgactgatttggataaaataaaaccgaaattgaatatgtccccgcaggaaacagccatcgctcctcatctaaccgtacgggaaaacttagagtttatagccggagtctacggaattccgaaaaaagaagcaaaaaaaagaacagatgagatgctcgaattgtttcaattaaaagagaaagaaagagcaaaaaccaaaaccttatcaggaggaatgcagcgccgcctcagcatcgcaatgggcatgattacgaaaccggatatttatttcttagatgagccgacattagggctggacgtccgttcacgccgcgagttgtggaaaaatcttgagacattaaagggagacatgacgattattttaacgacacactatttagaagaggctgaagcactggcagaccgtatttgcattttagaaaatgggacattaaaagcactgggcacggcggaggatctgaaaaaacaaactcattcagccacatttgaagatgcctttttagcgatttgtgacggagaggcgggtctttatgcttgatttcgccattcgcaaccgcaaagagatttttcgtgatcccttatctatcatccttggaatcgcactgcctgttattctattgtttctgtttacggcgattgaaaaaaatgcgccgcttgatacctttaaaattcagcatttagcacccggactcattgttttcggtttcgctttccttacgatgttctctgcattgctgatcgcaaaagacaaacagaccgcccttttgacccgtttgtttgcttcccctttaaaaacagccgattatgtcatcggttacgcactgccgatgcttccgttagccattttacaaatcgtcatttgttttatcgcagctgctgctgccggtttatccgccgagtggatgaatcttctcgcaggtatcgctgtcttgctgccgattgcgatgatgtccgttttcttcggtttatgtttaggggctgtgtttacggacaaacaaatttcaggtatcggaacgatttatattacactcgtgcaatttctgggcggggcttggatggaggtgagcctgctcggtgacacattcaaacatatcgcttatgccttaccgtttatccactcgatcgagctggctcaggaagtcatatccggagattattcttcctttcatcagcatatttggccgatagcgggatataccgttttggcgcttgcacttgctttcctcagttttataaaaatcaggaagagttaaaaaagccggcactccgtaatgggagcgccggtcttcttttttacgtttctttcagaaggcttatcgtatgcggcagcagacggtcatcccccggactgccatggcccggaacgacaatgctgatgtcctgatatcttttcatgactttgcggacggcgcgcggccactgatccggataaaagcccggagttggtatgatttcctttgtttctaaagccttgattaagcaaccgccgaataagagcttatcctcaggcagccagacggtaatattgtcttccgtatgcccttttcccggataaaacgtttcaattttcatatcgccaaactgcagctttgtcacgtttttcaaatctccgagcggccggtcatatccctgctgccgggcgaagtcggcggtcagcttcgtgctgtgcacctttacaccgtatttgtacagtgtgttcagcccgccgatgcgatcgtcatgggcgtgtgtcacaatggcatcggtcatccttttgccgggaaaccgctgttttatttgtgtcattaattgctctgtgagactgtcattccacggagtatcaatcagtacgattcctttggaagtttcaagaagcaatccgttcgcagggacgggacttccgtctgccgtaccgatgcttgtatgcatccagacatgcggcgccagctgtgtgagagtgacatcttttgctgcggagctctccgccgcgtgtgccggtttcattccggcagtaaagaggccgaatagaaataaccccgcaattaataatgaaagctttctcaaattgaatcattcctttccgcatctttcatatatacggctcaaaaaaacccggagatttccgggctttttcacacatattgatttatcaaccggccttttcccataatttgcggcagacgggaaagagagcgcttacgtttttcctcatgcattttcttttctgcggctgcggtgttttcctggcggcgctccacctctctgtacaccctgtcattggcgagggcggccgctttcgtaatgccggcgtaatcaggcttataacccgctgcccggtttgcgtattgagaatactgctggttttgaatccgtcctgcataaatcatatgtacccctccccttcgcttttcatttcccttaatcttactttttgaaacgcggttcttttgttatgatattctttgtctatcaaatggatgaacaccttttaatgggaggacccctttttgaaatgcgcccgactgaataaccgaacgatacatttacatacatattctagagaacattaccaattcctttttgaagaagctcagaaaggaaatattttttgcgcacattgtgaccagcctgtcttgatgcggctttcgattttagagcagccggcattttatcaccggcaaaagggagacttcaccgcctgtgaaaaagcatgcgccgccgaggaaccacaagcggagaaagaaaaagaagagtataaggaggcaggcatgttccgcctgccgaaaggaaaagcgatttcagagaatccgaaaccgatcgtctcagaatggaaaagcccgaaaaaagtgcctgcggccgaaccgttttcaccaacatccgaggcagctgatacatctttgttccccggcatcggcctgaaccgcgaacagatgcgggcagtcacggaaacggacggccccctgctggtgcttgccggagcgggaagcggaaaaacaagggtgctgacagcccgcgccgcccatatgattgaacacctcggcatttcacctgagaatatgctgcttgtgacctttacgacaaaagccgtcgccgaaatgaaagagcggatggcgaatgagtacgggctggcagccggaaaagtctcccgtctcgtgaccggaacattccacagttttttctataaaatactctatcattatgattcttcaaaatggaacggcagccagcttttaaaaatggagtggcaaaaagagcaatatgtgaaaaaggcgctctatgaagaaaatttggatgaaaaagagtttcccgtcgaccaggcgctgcagcttatcggctgctggaaaaacacgtatctcccccatgagaccattccgcttgcggacgactgggagaaaaaagtgtaccggctctacgaacattacgaacggcagaagcgggaaaaacggcaatttgattttgatgacatggcccaaggctgttatgaactgtttcaaagccggcctgatattctcgcgcagtaccaaaacagattttctcatattttgattgatgagtttcaagatattaatcctgtccagtacaacattatgcaaatgatcgcaagcccggagaataacctgtgctgcgtgggtgatgacgaccaatccatttatgcgttccgcggcagcagcccgtctttcattcttgattttcaaaaggattatccggcagcaaagaccatttacttaacggcaaattaccgctcgccgcatccgatcgtctcaagcgctcatgccgtcgtaaagaaaaataaaaaacggtatgaaaaaacactttctgccgtcaaagacggcgttcacaatcccgtgatgttttatccttacgatgaagaagaagaagcgaccatgatcgtttcggatatgaaagagaaaattcaaaacggggcgagtcctgatgattttgccgtgctttaccggacaaacagcgccggacgggccatttatgaaagactgcaccaatcatcgattccttatcatgccgaccgtggcgtgcagacgttctacagccgcagaatcgtacgccagatcctcgcctacttatatgcgagtcagaatgaagatgatacggatgcggtgaaagatctgctgcccgccttatttttaaagcaatccgccctgcaaacgttaaaggcgctgtcaatcacggaagattgcacgatgattaaggcactgacgaaactgcctgacctgaagccttttcaaataggaaagatcaagcagatcgttccgtttttcgcaagcatccggacaatgaagcccgttgaagccatcacctttgcagaaagcaaaatgggtttttccgagtatttaaaaaaacggggcaatgagggaaacaaactggaaaaaggctctgatgatctcagggatgtcaaagtggccgccaaaaaattcaaaaccattcccgattttcttgcgcatgtcgatcatatgcgcgccgctgagaatcagaaaaccgatgaaaacggcgtcgaactgctgaccattcaccgctctaaaggtcttgaattcaatacagtctatattttaggcgcggctgacggctcgataccccatgacttcgcgcttgagacagcgagacagggcgatcccgctccgctcgaagaagaaagacggctcctgtatgtcgccatgacaagggccatgcagcatttatatgtatcttgtcccgcgtacaggcggggaaaaacagcgcgcagctcaagatttctcgagccccttcttcggacggacagacggagcgcactcaggatataaagaacccggcagatcactgccgggttcttctcacataaaaaggcctttttagcaaggccggctgacgcctatttattgtttaacattttagaaatggtgccaaaatcaagtttctctttaccgcttgtaatcgattgaacgattttgtcttccaattctttcggaacacgcttgttagccagctgggacaccttctgaatgacgcctctcaccgtgttttcatctttgaaattggcattttgcaatgatcctgcaaggttcatgacatccttcatgctgacgcctgttttcttctcaatatttttaaaaaattgattatccatggtgtgcctccttttgtggagtaatacgatattgtatgaataaagggcggaacgtgtgcccgtaagacaaggaaaaaattccgcatctccttctctatccttcatacattagggaagcacgggactgaacggtcccgcgcttatccaaagtcttgctaaggtttagccaaaaaaggatgcaccgacaatgatcagaaggatgaacaatacgacaacaagaacaaatgttgagccgtatccgcctccgacatagccgcctccgtatccgcagccgccgccgcagccgtaaccgccgtagccgccgccgaatccgccatatccgaatcccatatttaagcacctcctttactctctatactctatgtgagccgacttgtttggcttggataaatgcatagggccggtgcggatttcttttcattttattgagaatgctcatttttcttcagtttcgcttctgtttcggcggcaaacacatctatccattcctcaaagcgcgctcccgcttcatcaaactcagacagctgtttttcaatagataagatatagttgtcatgctcccgctgattttgattgtgccggcggtatttaccgtttatgaatgattcaaatatattcataacatcccctcctcctatgatctatgccgggcagaggccggcgttcggcaaaaaacaaaaaaaccggaagctccggttttttttgaaaacggctatttcggttttttcttttggccgcagccgcagccttttttcttaatttttttttcgtaaggctgatgcacagttgatttgtatggagagtgttgggaaggtttgcttgattgattcatggtgatccttcctttccttatgtcatatatgccagtttatgccgaaagtgacggtaagttgctggtggaaccgccttattcctgcagaagacgagaaaccgcagcttcaatgatcccggccgcgccggctatggctaacagcaaaatcagccattgcgcagcctcggggatcacaatctgcgccgcaattaaaaaggcggcgcaccatacgcccgtacaccaatagcagctgagaagttcaccgataaatgccctgatgccttttccttttatgacaatgtaggtttctgtcgtgccgtcgggtgcggtttctgttttttcctcgtgaaaaaggctccgaagcggcgccataatggtgtcaaatacgaaaagcctggccagccggaaaacggcaaacgataacagaataaatgaaagccaattgataaccacctgttcactccttttcaaaacttgacctctttatacatatgcgaaaaccctgatcttcatgaatcgcaccttgtccggtaaaaaaataggtgcggtttagttgtttttcttattccgctcggcgtttcatttgcattatatagagtatgaatgagaaaggagtgaaggttatgtcgtttgaagaaaaagtcgaaacactgcaaccgcaaatatacgaacaattatccaacgaattcgagcagacgatcgaagtgattgattgcgaaaatgtcacaatagatacaacacatataacggccgctctttctatacaagcctcagttactacggcgattatcctcgcgacacagctcgcgatcgcagatgaagacacagccgaccaaatcgcaaccgaactgctgatcctggatgattgccaaataaaaaagaggaccgtcattcaagtcctgaacagccgcaatattaaaatcacactgacagcagacgatatcatggcctttgtacaaattttgtttcaattattaaatatactttttgctgaactagacatcctttaacctttcttttcaaatatttaaatagaggtgagaacaaatggcagataacgaaaaattaaaaaaagaactcgaaaatctaccagaagtggatccgcttttaaaggtgcttgtcagcaatgtcttcaaaaaacacggcgtgacaaaggataaaatgcgggaaatccctgatgaagaaaaagaaatgctgatcgcattagtcaaagacatgcaggcgaaaacagaagcttttcttgaaagccagaaacagaaaaaagagcaggaaaaagcgcaagaacagcagacaaatccgcaaacccgcagagaacaattaatcgaacagctccggcaaagacgccaaaatcccggtcaataactaaaaaatagtgatttttatcaggatagatgcctgagtcaaaataaggggccggctcatttaataatagtaaaagaaaaggaggaatagatatggaaagcagaccatactcttgggttgcacttgatcctgaatgcgaacatccgcgagaagaaaaagaagaaaaagaaggaagaagatgcagtgtttgctgtaacggacatggatttggcgaagataatgccttccttgaccaagacctggctcaggcgaatatcaacaaacaagtttctgaagaagcgattattatcagagactcttgtgatattaacgtaacgtcaacagacgttcaagcagtcgcttcagtcatgacagcgattaatgcagcagtcgtaacggccactctcacttcaattgctgacggagtcatcgctgaattggtcgcacaagacttattgcagctaacagctaacaaacaaatcaaccgtcaaaaattgctcatcgaaaactcccgcggcgtaaacgtgacaacagtagatgccgatatcgcagtgttgatctcaacagcgacaaatttactgattgccgtcttagtcatcacccttgtcctctaaaaagaaaaagcagagctaaaaatgctctgctttttcttattttctccgcatatgatgaatatatagacgttcacccacaccaagtgaggctcgcgtacatatgttgttaaagacaaaagtcaaataccctaaaagaaggagctgaaatccatgagctgcggaaaacaccatggccgagatgaaagttgtgtatgcgatgcagtcgagaagattttagcagaacaagaggctgttgaagaacaatgcccgactggatgctataccaatctgttaagcccgacggttaccggtaaagataccatcccgtttctcttgtttgataaaaaaggcggtttgttctccacattcgggaacgtcggaggatttgcggatgacagccagtgcttcgagtctattttcttccgggcagaaagagtttgtgattgctgcgcaacgctttcagtattgcgccccgtagatgtgcacggcgacaccctcagcgtctgccatccttgtgacccggatttcttcggtttagaaaaaacagatttttgcattgaagttgatctgagctgcttcagcgccattcaatgcctttcaccggagcttgttgaccggcctgagccgcacaaagagaaaaagcatcacggatagtcattgattcgcatctttcctaaagaagaatccccttccaaccttctattacagatgcaatcatcagcccgcccggacttccgggcggctgactctccgatatcgtttaatccggtatataaaacgtgaagtcaggagggatattatgagcaagcatacaacatactgtgtgcgtgaagcggtagaaaatattgaagacctgcaaaatgcggtcgaggaagattgcccggccggatgctattccaaccttttatcgccgggtttttcattaggcgatacagtgccgtttgtacttttcacttctaaatcatcaccgtttaccgcattcggaaatgtcggcgagctggataacggtccgtgttttaacaccgtttttttcagagttgaaagggtctgtgacggctgtgccacattaagcctgcttattgcttttgacgagcataagcacattcttgattttacagataaagactctctctgcgatgtattccgtttagaaaaaacgaactattgcgttgaagtcgatctccatagcttctgcgccatcaattgcctgaacccgagactgatcaaccgcacacattcttaaatcaaaaagcataaaaataagctgccggattaaagaattcaggcagctttttgtatggttaaaatccaagcggatgcagcgaggtaatatcgtctattgcgagttctgccggcgctccgttgcttgtcgtccgcaggaagatcgcattattttttcttccgacgattacgcctctgtaggttttcccgttggcttctatcagacaaagggtccgcggcatattatgcggcagcttcgttaagaaatcaattttttcaagaatggacattctgctcatcggctttttcacgcgctttggcgggaccttttcctctggggcggcattgtgaaccgcttcaggctctttttcagcggcttcaggctcttttttagcggcttcaggcttggcagtgtcctgctccgcttgcgccggaacttcttgaacggcttcttctgagcggctgtgctgttcaggtacttgcttttctggttcgacagccactgctccttcaggctgagttttacattcttcctcccgctttccatgcatcggctcttcttccggcggctgcggcgctttcctttttttgattaatatgtcctgcattgatgattgcgtgtctgaataatccgcctgaacaatatacatgagcggttttttttccgcgtttctgttttgttttgacatcttcatccctccgattctgtcatgttttatttatatgacggaatgattaaaatcagaagaaagaaaaaagcaatccctgaaagggactgcttgttatttaacgtgcggtaatatggaatcctgaatccacgtgaagattttcgcccgtgatgcctcttgacaggtcactgaacaagaatgcagccgtgtcgcccacttcttcaggtgttgtcgtgcggcgcagcggcgcgcgctcttcaatttctttcaggatagagttgaaatcactgattccttttgcagacagcgtacggatcggccctgctgaaatgctgttgacgcggatgttttcttttcctaagtcagcggctaaatatctcacgctcgcatcaagagacgcttttgccacacccattacgttatagtttgaaacgacgcgctctccgccgaggtaagtgagtgtaacgatgcttccgccttcagtcataatcggacgcgccgcttttgcgaccgctgtcagagagtaagaactgatgttatgcgcaagcaggaatccttcgcggttcgtatttaaatattcgccgacaagctcttctttgtttgcgaacgcgatgcagtgcgcgatgccgtgaatcacgccgacctgctctttaatgcttgcaaagcaagtttcgatctcagcgtcatttgtcacatcacacggaaggatgatggaatcatttctttctaatgtagccgcaaggtcatgaactgatttttccaagcgctctcccgcgtaagtgaaaatgaggcgcgctccggcttcatgcagcgaacgggcgattccccatgcgatactgcgtttattggcaacgcccatcacaacgatgttgcggccttcaagtgagaaattcatatgtataaagcctcctgtaatcgtcttaaagacatagttttagtacctgatcttaatttttatcatatcataaccttgtccagattgaaagcatgggaaaaagaccgcggatgttgaagcggtctcttttttatctcgtctgcagactgttccttttaaaggcaaaatgattggtcgggccgtgtcccgctccgatgccgagtgtatgttccacggcttcccgcacaaaattgacagctgtctcaaacgcggtctgaatgtttttcccctttgccgtttctgccgtcagcgcggctgcgaacgtgcagcctgttccgtgggtgtgtttcgtgtcaatataagcgtggctgatttgggtaaaagacgaaccgtcaaataataaatcaacgattctcccctgttcaggctgatgtccgccttttatgatgacatgctttgccccaagcttgcaaaggcgttcggccgcttttttccggtcctcaaacgtgcggatttccatccccgtcaatacctcagcttccggaacattcggcgtcaccgcatagctgcgcggaattaacagctcttttaacgcggcctgagattcctcacgcagcagggaagcgcctcctttggcaatcatgacgggatcggtgatgagatgatcaagcccgtactgatccgttttttccgcaatttccgcaatcatttccgcgctccacagcattcctgtttttacagcatcaggccgcaaatcttccgccaccgcgtcaatctggctgcccagcgcctcccgggtgagcggataaatgccgtgaacgcccaacgtgttctgggcggttaccgctgtaagggctgacatcccgaaaacgccgagctcctgaaaggttttgagatccgcctgtataccggcgccgcctcctgaatctgatccggcaatcgtcaatgctttgcatatgctcatgatgtttttcgctcctttcacattatccgatccatttatgataaaaagatttcgctctgctgatatcacttgtgccgtgtattaatgctctgccgtcacgaaacagtaccatcttgaaattgtctgtgcaaaatgaaattaaatacgggttggctgaaacatcaagccctgcccgtctgagctgtcccgcaagattttgcagatcaaactgttcggaaatccccgttctgatctgcaccgtgttccgcccgcacagaaccgccgcttttgtctgattttcataggataaaaacggaaaatcgtttgtgccgcagcttgggcaatcagccgacttaagacgggcgacgtttatttctgaccgttcatttttccataaatcaaaggaacggagaacatgctcgatagatccgcccgttaacagcttcagcgcatctgctgcctgaaaaacggccgtctgcaatacagccgggctgatgattcccgccgtatcgcatgtcataccgcctaaaggcaatgtctcaagcagacagtgaaggcacggcgtgacaccgggaatgacggtaaaagagagcccgtagctgccgacacaggcgccgtacagaaagggaattcctttctgcacagccgcatcattcacaatcagcctcgtttcaaagttgtcggcggcatccacgatgagggaggcatcacgaatcaatccgggtgcgttttccgcagtgacatccatgacaaatccctcgacctctacatcgctatttatagaccgaagccgtttttcagccgccgcggctttcggcatttcctgtctgacatcgtcttcggtataaagctgctggcgctggagattactccactccacataatctctgtcagcgatcgttaccttcccgacccctgctctgacaagcatctccgcacttgccgtcccaagcgcacccgcgccgataatcacggcatgagacgaccggagcttctcttggccggtgggaccgatcggctgaaacagctcctgtctggaatatctgtccgtcataccggaagaccgtctcgcggactgcttgcagttccgtaatctttcaccggaattctcccggcttcataagaaagacggcccgcttctacggcaagcttcatcgccctggccattttgaccggatcatctgcgcctgacacagcggtatttaacagcacgccgtcagccccgagctccatcgcgtaggcggcgtcttttgaagatccgacgccggcatcgacaatgaccggcaccttcgcctgttcaatgataaaagaaagattcagcggatttaaaattccctgaccggaaccgatcggcgaagcgcccggcataatggcatgcaccccgagctcctcaagacgtcttgcgagcacgacatcatccgacgtatacggaagcacgataaatccctcttcgagcagctgttctgatgctttcagcgtttcaaccggatcaggcaaaagtgaccggctgcatccgatgacttctacttttatcatgtcacaaagccctgaagctttggcaagccttgcgattcggaccgcctcttcagccgttgcggcgccggccgtattcggcagaagcgtgtatttagacaaatcaagctgttcgagaaagttaggctgagactcttcaaagatgttcatccgccgcaccgcaaaggttaaaatatctgattccgagacggccaccgcctctttctgaatctcaaaactcggatattttcccgttcctaacagcaatcttgaccgaaactgttttccgcctattgttaacatcctcatccgcctcctacaaaatggacaatttctatgacatcgcggtcacacaaacttgtattttcataattctttttttcaatgatttctttatttctctccacaactacgattctttggtcaagctggtacgattcaagcaaatcctgaaccgtcccctcttttcgattccaatcaatttgttttccgttcagctgaaggatcatatatgaacagcctccttgcgatcgattcgaaacgcttcttcccattcctgtttaatctgtctttccatgatcatatcccgcaccatttcagccgttgccggcgccaacaggatgccgttccgaaaatggccggcggcgaagatgatgccgctgtcttcagggtgttgcccgataaacggcttgccgtctcttgttcccggcctgagccccgcccaaaaccggtctattttcatatgttcgatggcgggaagcatggttttcgcttttgcaatgacggcctcaattcctccgatgtcaggcgtatcgctccagtcgccctgtttcatcgtggcgccgatgacaagccggccgctttttctcgggacgacataacaatgatcatggtaaagggttttggtcagcggggtatcgtcattccacacggaaaggcattctcctttcacaggaaaaaaaggctgtcccaagccgagccggctgaaaaaccggccgctccatacaccgcttgcaactgcgactttgtcagcataaacatccccgccggacgttgtgatgcaatattctccgttcacccgttttacggaagtgacttgtgtgtgctcatatatgtcagcgccatagcgccgcgctccttttgcatacgctttgcaaacatagtacggttcgacatggacatcgtcttttataagacttgcgccgagaatgtcttttgaagcgtaaggctctttttcaagggcatcttccgctgaaagccaagtgacggaaggcagatcatccatcttccgtaaacgggcgatatcttcttcggtatacgccagtttaagcattccgccgttatggcgcctgatgtcaatgccgctagcttcctcaagctcttgccccgccgcttcatacagcctttgactgtgcatggcaaaattaaaaaacgcatcccggttttcacattccgcatgagcacccagcattcccgcggcagcgcttgtcgtttttcggccgacttctccggcttcaaacaagacaacgttctgctgcgtcttcgccagctcataagaaatggcacacccgataattccgccgccgatcaccgccgtatcatagtgctgcttcataatcggcctcccttaccgcacgtgcataccgttttgccgcctcctcgggattttcagctgagaaaatgcctgacatgacggcaattccgtccggcttcgcctgctttgtgtgtccgatcgtctgcagtgtcattccgccgattgcgataacggggatggaaagcgtgcgtttgatctctgaaagcaggctgatgcctcttgcttcaagtccttgtttacattcggtttcaaatatatggccgaacaccacataatccgcatcttccttttcagcttggatggcttcttccagcgaatgaaccgaacgtccgatatgaagatggggaaatctgcttcgcacctgctttacggaaaagctgcgggacggaagctgaacacggtgtatgttggcaaaaagcgcgatatccgccctgtcattgatgatcaatttgtccttatccgcaccgccctttttcaaaagggacaaaagctgcatgatctctcccgctgttttatcccgctcacggatatggataaagcttacttcgcgctgaatcgatagaatatcctcggccagctcggcaacgggtttgcgattatcagttaccgcgtgcagctccaaaggattccacctcttttccgtccttctcggaccagccttctttttgataagccattccccaaaattgatattcataatagcttgaaatcacaaaattctctttcattttcgcgcggatttcctctgtgctgttttcagcaatctcgtcaaaacggctgatctgttcttcgacctgctgtctgaaccagtctccgccgtatgtaccgatccatttttcataaatcggatgctccggtttgcactcttttaggtgttcgccgacttcataataaagccaataacaaggcagaagcgcagctaatatttctccaaaattgccgctcatcaccgacctgtacatatgagacgtataagaataggcggtcggtgccggtttaaatgctgcacgctcttcttccgtaattcctaaaagctccgtaaactcgcggtgcagcgccatttccgcttcatatgtcccttgagcgtggcccgccatcctgcccgtcgtaaacaagtcttcggcatatgcggcgccgaacgcctgaacttttgcaaaatgcgtcaaatagtaggaatcttgcagcacgtaatagctgaaacggtctatcggcaggcttccgtcaccgattcccgttacaaacggatgaacaaaacttccgtcccaccattcggcagccgcctgtctgcattcttcagaaaatgtcatcatgtcttcccccctgataaaataaaaaaaccactttcccgcatcggaaaagtggtttggaatttaaatggataaaaggaaccccaaaaaaataccgctccacttccctacgcaggtctgaacctgttcaagttatgagggtctaaaagtctcacttttatctcagcccttatgaaggacacccctagtggtcatacgattaatgatttatttgttatgccttctatattatcacgaattgcaatttggtcaagcttcaaggatttttctcagttctgacacgtagttgcgcgagcctgtgacgatgagacggtctcctgttttcagccgtgtgtctccgtgcggaacgatgctgtccacacctctgaaaatccggacgaaaatcacatcgcccatcagcggaaattcccgcagaatgatgccgttatacgccgggttttccagattgatctgatataacgaagactcctcattcgtcaggaggctcatcacgcccggcgcctcaattaacgcgcgcagcagcgtttttgtagacagaaggatagaaaaaatactgatgccctcttctttcagttttgtttcatgctcaaccgagccgacgcttgcgatgatacgctcagtccctttctctttcgctagtaaggcgatttcagcgttcacatcttcatttcccgtcgccacgacaagaatatccgttttgaaaataccgtgcgactcaagcgtgccgggctcgtaatcagaaatcgtgtcaaccgaaaaaacggattccgcaagcgtttccccggcattttcctgatacacatggacgacccgtacttcatattcctcctcaggcaattccagcgtaaccgggagcgtcatttggttggcgccgataaatgtaatgcgctttttttcctgcggcgcgctttgccgtttgaataatttcttaaagccgatcggcgtgatgatgctggcaataaccgcaactaaagtcagcgcgccggacatattggcgctgataatgtggagcctttctccgatcgtagccgccgcgataacaagcgacagcgtggacgtcagcaaaaagcccgaagcaaacacggttcttttgtcgtaccatttctttaaataaaacaccgggaacattttgctgataaacagcgcaagcagaagcagcggaatcatcgttaatgttttcggatcttggaaaagcgtccaaatatccaatttcaccccgaccatgacgaaaaagatcggaattaaaaacccgtagccgaaggaatccagctgttccaccatttctttattcggagacagaagcgataccagaacgcctgccaaaaacgcgccgagaatattttccgccccgagagattccgataaagcgacaagcacgataatcagtgtgaaaatggctctcgtgccgatctgcacagtgcctttagacatcgactgcacaaatgaacggtgtttaaagatcctgccgaagaaatacagcacgacccccgcggcaaagagaatcaacagaagccacatatttccgctgtcttctccgtaaagagaagagaagaaagcgagcagaatcattgtagccaagtctgcgataacggcgacaagcaggatgatctggccgatattggagttcatgatccgttcttcctttaaagtcgggaccaccacaccgagtgatattgttgaaataataagcgtcattaaaaatgcgttttgaataaaaccggctaatacaaaggcataggacagcagcaatgataaaataaagatgccgaaaaagataatcagcgcggcagaaaacgtgttgggcgcttccttgccgttcggaaggaattgttttttcttccctttctcaaatgaagaaaaatcaatttccaagccgcttaaaaacattaaaaagataaagccgagaacagacagcgtctccagccacgtgtctccctgaacgacaagattcaggccgctttttccgataataagccccatgatgatctccgcgacgacgacggggatgctgagcttaaaccgatgtaaaaggagcggcgtcaaaaaagcgacgatcagaacgacgactaaagatgcgactgatgtgtgttccatttgtaaatacctccttaaaacaagggttataaaagcccgctttaagcggacgaaaccttactttttttaaaaacataacgcatattctaacaaggcttaacgcgaaaaaaaagtgataaggctttatttcttcaattctttttttaatttgtaccaaaacagcgtaattaggtataggaattagccccataataaataaaaaaccgttaataaggaggctgacacgaatggcttatgacatcatcagcgatatacacggatgttatgacgaaatgatcgccttaatgcaaaagctcggatatgaagtgaaagacggaacgcccgtccattctgaaggcaggacgcttgtctttgcaggggatttaacggacagaggcccaaaatccgtagaagtgatgcgttttgtggcaaaagcatatgaaaaaggagccgtccgttatgtcccgggaaatcattgcaacaaactgtatcgttacttaaaaggaaaccctgtaaaagtgatgcacggactggaaacgacggcagccgaactgaaagagctgtctcccgccgacagaacggaagtctccggacaatttatccgattatatgagtcagcgccgctttatgacattttacataatggcgatctcgttgtcgcccacgccggcataaaagctgacgatatcggtaaatactcgcgtaaggtaaaagaatttgttctgtacggcgatattacgggtgaaacgcatcccgacggcagacccgtcagaagagactgggctgccgactatgaaggcaaggcgtgggttgtgtacggccataccccggtaaaacgcccccggatcgtcaaccgtacggtcaacattgatacaggctgtgtcttcggcaatcagctgacaggctttcgttttcccgagcatgaaaccgtctctgtggaaagctctatgccgtatgatgcttcacgatttcgcgaggatcacggcaggcaggcatgaaataaagcccgaaaccggcaaacggttcgggctttacatgtgttcaattaatgttttcatatcgtcaggcaccggagcgtgaaaaacgagcgtttctccggtcatggggtgtacgaatgaaagccgctcactgtgaagagcctgccgggcaattccctcattttttccgccgtacaatgtatcaccgactaacggatggccgaggtagctcatgtgcacccggatttgatgcgtccgccccgtttccagccgcagggctgcaagcgtaaacgcatgtcccgctttttccgtttgaaaatgcgtcaccgctcgttgtccatccggcgttaccatccgctcaataatactgtcgtgttttcttccgatgggcgcgtccaccgttccttccttctgcagcatgatcccgtgtacgacagcgagatatcgcctgctgacaagcccctttttctgtgctgccgacaaaagagaatgggaaagccgatgtttggcgatgagcatcgcccccgatgtgtccctgtcaaggcgggtgacaagatgaaccgttgattgcacgccgctttttcggtagtggctgatcactccgttagcgatgctttttgacgggtgttctcttgatggaattgaggagacatacggctgtttattgaccacaagcacatggtcatcttcataaagaatatcaagcggaaccggctcaggcaaaagcgtttcactcacatgctccttcggaaattcaatcttaagcacgtctccctccgctaacacggtgcggacggttacatgctctccgttcacaagcaggtctcccccgccgaatttaatgtcagcgagaagccgctttgaaatgccgagctgcgccgtatattctttaaccgtcatgccggcatcccgggcagtcatgttcttttggataaaaaagttgtccaatccgtttcctctttctattcgccttttccgataaaggaatcctgcacccttttccaaaacggaaaagggcggaatcttgcaaatctgactttttcatttgccacacggcatagaatggacttgacatccttatgcagcaaggttaaatgatcaattgtgacttgaaagtcgacgtcgtttctcggtttgatgacacagttatgatgatcgggaagcaaaagcggcgagccgacagtcctgaacactctgttgttgatagatgccatttcggcaagctgaatcgccctgatggaagggtggatgattgcaccgcctaacgccttattataagccgtgcttccggaaggcgtggacagacataaaccgtctcccctgaacgtttcaaacagctggcctttaatttccacgtcagcgacgagactgccttctatgcttttgatcgtacattcgttcaaagccagataccgctcctcacgctcttcatcatgataagtgacaatcacctcaagaaggggatactccacggtatgatacggcgttttggcaatggccagaacgagcttttctatctcctgcggaacccaatcggcataaaaacccaaatgccccgtgtgaactccgacaaaagccgttttatcaagacggtcgctgtacctgtgaaatgcgtaaagaagcgttccgtcaccgccgacggaaataacgatttccggctctttttcatccaaggtcatatcaaaatcgagtaaatacgcctgtattttgcttttcagtgtatctgaaacctcgtctccttttgaagaaacggcaaatttcatgccattcccctcctttccttcctactggcggtctcccgcttttttctttcgcgagaacgcggcttgggcttcctggatttctccgcggatttctgacatttcttcatcgagccgggatgcggcttctgaggcccgctgcagcctcagctttactttttcgggaatgttcccgctgtatttgtaattcagtgaatgctcaatggttgcccaaaagttcatggcaagcgtccgaatctgtatctccacaagaacgtgcttttcaccggacgttgtttgtaaaggatataaaacgacaaggtggtaagaccgatatccgctttccttatgctctgctatgtaatcccgcttatcgacaacggtaaaatcttttctggcaaacagcatatttttgacgatctggatatcatcgacaaattggcacataatacgcagccccgcgatatcctgcatcgtttcaatctgatgaagcggtatgctttttcgtctcgctttttcaagtatgctcgccaccggcttcacgcggcctgtcacaaactcaatcggtgagtggtcatcttcatactcataaagggttctgacgcctttcagcttcacctttaattcttcaacagcctggcggtatggcgctagaaattgctcccattgtttgtcatccatcgtacatcccccaattccgaacctgttctaaagaaatacgtttttcactttttcttccatatctccgtagtttgcattatctttaatattttcaagaagataatcgagttcttcatgcagccctgaaagttcaaccgttttcgcgccggcctcaaggaccgccggttttccttggtctaaggcttctttcagatccggccagacatgttcttttataatgacatattcaaaagagtcagctgattcaagtatgtatacaaaagcaaagtgatcggaatcaacaagcatttgacctgaggctttgcgttccgctccgcttaagtcttctccgcacttcaagcggagcgcgtcttctgttaatgatgcattctggatttcaattctcttttgcataatgttctccttttttaacaaagtacagcatttattttatcatatcaaggtcgatattgataaacgtaacctctaaagagataatgggaattatacaatttttcgtcctgaaaggaagactgtcatgacccaagaaatagaaattgaattcaaaaacctgctgacaaaatcagaatttctgaagctgagtgaagcactctgcatgaaagaatatgattttaaacagcaggtcaatcattatttcgacacgaaagatttttccctgaaacaaaaaaaatcagcactccgcatccgagaaaaagacggctcgttcgttctgactttaaaagaacctgccgcggtcggtctgctggaaacgcaccaacagcttgcggcggcaccggatcttgacgtcttcaagattccggatggccccgtcaaacggcagctggacggtctcggaatccgttcagaacacatttgctgcttcggaacgctgtcgaccgcacgcgcggaaaaagaatcagaaaaaggcttaatcattttagatcacagccgatatttagagaaagaagactttgaattggaattcgaggctgctgactgggatgaaggaaaacaggcgtttgaacaattgctcaagcaattcggcatcccagagcggatcacgaaaaataaaatccagcgtttttatgaacagaaacaaaaaaaggtggaatgacacagtgaatataacgaattgggcggcccttctccagctgcagtcaatggcgctgcaatcaatctctcatacaagcacggattcaggcggacaatcttcagaaagcccgcttgccaatttcagcgcgctgctcagccagtatacggacacagccgtccggcagcagccggaatcagggattttaaacggtgtgcggaccgctcacgcttcatattcaccgagaattccggtttcatccggttccgcggcagcttcacagaccgtttccccgagcataaagtctccgaatgcggcttctgacatcagcaccggaaacttttcaatagacagcgccattcagaaagcagccgaaaaatacggagtggacgaaaaactgatccgcgcggttattaaacaggaatcaggctttaatccgaaagcggtcagcggtgcgggggcaatggggctgatgcagctcatgccttccacggcagaatcactcggggtgtcaaacccgcttgatcccgtccagaacgctgagggcggcacaaagtacttaaagcagatgctcacgaaatacgacggaaatgtatctctcgcgttagccgcctacaacgcaggccccggcaacgtagatcggtacggaggcatcccgccgtttaaggaaacacagcaatatgtcaaaaacataacccggcagtattacgcgtaaaccagagaggcttccttcgccctctggtttttttgcggagtgaaatcttacacatgaatgaaggcgatgtgatatgatatgaaatacaagcgcctgacagaaaggcactttgtttgtagaaataaaatgttattgctaaaatatacagtaactgaagatagtaaaactgaaagataaattcgcaatgggaattatgattcctattagccatataaaggagtagtcaacatgggacaatcgtttaacgcaccatatgaagcgattggagaggaacttctatcgcaacttgttgatactttttatgagcgtgtctcgtctcatcccttgctgaagccgatatttccaagtgatttgactgaaacggccagaaaacaaaagcaatttttaacccagtatttgggcggacctcctctttatactgaagagcacggacatcccatgctcagggcaaggcatctcccctttccgattacggatgagagggctgatgcgtggctaagctgtatgagcaaagcgatggatcaggtcgggctggagggcgatattcgtgaatttctgtacgggcgtctggaactgacggccaggcatatggtaaaccagtcagaagcggaggatcgatcatattgacgaattatcagcatgagcaatacttcgcccattgccacggacatccaaaaaaaccgctcgaaatttacatgtttgtcgaccctttatgtcctgaatgctggtcgctggagcccgccataaaaaaattaaaaatcaaatacggacgttttttcaccctgcggatcattgtttccgcgagcattacatcgctgaataagcaaaagcggaaaaaacaccttcttgccgaagcttgggaaaaaattgcgaaccgttccgggatgccctgtgacggaagcctttggcttgagcaggatcagcctcttgcatcgccctaccttgccgcactcgctttaaaagcggccgaactgcagggaagaaaagcgggcattctgtttctccgcagcatgcaggaaagcctgtttgtctccaagcagaatattacggatgaagacgttcttttagaaattgctgaaaagacgaaattggatgttgaagaattcaagcgcgacctccattcgcaaagcgcggtaaaagcgcttcagtgcgatatgaaaatcgcggcggaaatggacgtcaccgtcaacccgacattgacgttctttaacagcctgcatgatgatgaagggctgaaggttcccggcaactattcttatgacgtatacgaagagatcttattcgaaatgctcggggatgaaccgaagccttctgaaacgccgcctttggaatgtttcattgaatatttccggtttgtcgcatcgaaagaaatcgcactcgtttatgatttgagtctagaagaagttgaaaaagaaatgaaaaaactggcattcgccaaaaaggtcgccagagtggaagcaaagcacggtctgttttggaaatctctggccggaacccaggaggatgtcacctgttgtgaccattaaaaaaagctgattccttacggagccggctttttttgtgcaaataaagaaaccgcgccgggataagcgcggtttcatatgtcttaacgacaacaaaggggatgggagaaatttttcacggtcaaacaaaggggtaatgtttgtttgtgatcaatttcacatccttatcatatcaaatcttgtcgagttttgacaagccataagattaatgttcatatttttgtcacaaaacataactgactgcttgttttcatagaatatatcaatcataaacaaggagggaaatcaatgctccgcaccgtattgatcatcggaatgattgtgtttttcttctttttaaacctgctggccatgatgcacatgctgccgatttacattacatctccactgctgtttctgtccatattgtttgccctgtaccggctgaatcaccgaaaaacgtttaaggggttttagaaaaagcctgcgcatttaatgcacaggcttttttgaattacgaagggttcactttcgaaagaagctcttccatttcgttcagtttctcttcaaacattttgcaggccgcctcgatcggttcaggcgatgtcatatcgactcccgcttttttcagtatgtcgatcggatattccgagcttcccgcttttaagaattcggtatagcgctccaccgcaggcttgccttcttttaagatctggctgctcagcgcttgggccgcactgtagcctgtcgcatattgatacacataataattgtaatagaaatgcggaattcttgaccattccagactgatttctttatcaatcaccatgttgtcaccgaaatactttttattcagatcataataaagttcgttcagcagttcaggcgttagcggctcgccttcctgcgctttcgtatgaatcagatgctcaaattcagcgaacatcgtctgtctgaacactgtgcctctgaatccttcaagcatgtggttgagcaggtacagacgctgtttttcatcctttaagctgttcagcatatattcaccgagcagcgcttcattagtcgttgaagcgacttcagcgacaaaaatgctgtagttaccgtacggatacggctgatattttctcgtatagtagctgtgcacggaatggccgaactcgtgaacgagcgtaaacagattattgacattatcatgccagttcatcaagatgtacggattcgtgccgtatgtaccggacgaataagcaccgctgcgttttcctttgttttcgtatacatcgacccagcggttttcaagtccttcttttaaaatagacgcgtattcctcgcccagcggagcaagtcctttgagcatataatctttcgcttcctcatatgttaccttcattcccgaatcttttacaagcggtgtgtacaggtcataaatatggacttcatcaaggccgagcacctttttccgcaggtcaatgtaacggtgtaataacggaagatgtttattgatcgttttgataaggttatcgtaaacctcttcaggaatgctgttattggataaagccgcttcccgtgctgatttatactttttcacacgggcgtaaaaattatctttttttacagtgccgctgagtgtagtcgccatcgtgtttttatactgtccgtatgttttatatacggcttcaaatgcgtttttgcggacttcacgattgctgctttccaggaaattaataaagttgccgtgtgtgatttgagtttccttgccgttttcatctttaatcgacggaaacgtaatatcggcgttatttaaaacactgaatgtattggaaggcgaagacagcgcttcagaggcttccgcaagcagggcctcttcttgttcgctcagcacgtgcggacgctgttttgtaatttcttcaattgcatgggagtaaagcttaagctcctctttttcaagaataaactggtgcagcttgtcctcctgaatcgccagaatttccggttcaatgtaagcagtcgcgctggcagcctgagaatacaggcttgcggctttgtcgttcagcccttggtagaaagaatttcccgtatcctggtctgagcgcatatgtgcgtatgcataaagtttcccaaggcggttcgtcacttcatcctgtgccgtaagcgccgcgtataaattatcagccgaatgagcaagcgtgcctttaaatgaagataaattcggaattaattctttaactgcttgaaattctttattccaggcctcatcactaggaaaaatatcctctagtctccatgtatgctctgcctttacttcacttctctcaggcagctgtgctgctttattttcctcagtcatggtgatccccctcgttttctttacttcaagccaattgaaaaaacgattgtttctccaaaaacttgtgttgtgattatcttccggcttttcactgccttttgtcaaatcatatgcggcatataagaccgagcataccaataatacagtgaaaaaacgaaaacaaaatgcttgtacgcccctcacattcgccaccaccttgacgttagggtgaacgaaatgaagcattctcattccccaaaaaagagcaggtcccgccggcgcagctcttctgccgtttgagggcgcttctgttgagatgagggcatatatacttcattctcaatttcccttaaaaaatcctgcaagcataagaaatcagcatattgttttaccgccattccgataaggctgtcttgtgaaccataccgcatccggatctccttatgcctgattttttgccgtaaatcatgaaccatgccggataatcggatcggcgcgccttttttagaaagttccgcaagccgcaagtataaatggccctgccacacaaaaacgggacttgcaaacacaaagcctgctgaaacgggaataaacacttcagaggggagaaatggaaatgcaacctgatgtctttcgtaaaaaagacgccggataagaccggcatcttcagataaaaaccgcccgcctttgttgcggaagccggtaacggcacgcccccacgaggaaagtctgacgctgcgccgcccttccggatgacaaatgtctttcagatttgctttgtgaagagggattgcggttaagccggcataagaatagccggtgtaaaacggagtgatggaatgcagcctgtaaaaggagcgggcgtcggggcagtaaaacattaaggaggaaaatgaattgacttcaaagaactgccagtgaaaagcagaaagccggaaaaattgcgcggtcatccgttttaaccgttttgccccaatgatccagaccggccggtacccggcgtttttcaggcctgccgtccggctctttaaagagtccgccgaaaggttcgcacattgaaattcaaaagccagcctttcttctccgctttctgccgtcaagtcaggccgctgtccagcggaagtcagatacggttccaggctgacactgcacccttgtgtcttcagccagagaaaaagctgtctttttccttccagatggtattcgctttcaggttcggattccccgggacacagcctgctttttttatgagcgaagtgcggcagtttttcgcgtcccagtttgatatcaagctcacttttgcaaacggggcagaaccagcgtttctttctcagctccgccgctttttcctttgaatagcttccggccagctgaatgagccgtccgccggcagtcactgcactgaacatgttgcatcttctcctttcctgaatcttgttgtattcagcaggaagaaggcataatcctgtttgcggatgagagccgttatacggttttcagccgttcatcctgtcattcagaacaaaaaaaaccgatttctgctgagagaaatcggttttttatgatgcaaagtgtttttttattgtatataacgcatgatcagcgatcactaatttgccgtattcttcaagacggtgaatgctgactgatgattcgtgcgcgtactccaacaggatgcttagctgattttcaacctcttcatcagtttgctcataaaaatctgcatataaataatatcggtcttcaaacgaatacagggtcgttttgattccgttaagattcaattttgatagcgagatgagatcctcaaaatcatcgaaccgcaaagtgaactgaagcttttgctccttatcttcccggctctcggcctgctcttctttctggaaatcatcaagtaaagcatcgagattttcatctgccggctcttgttttttatcttccgggatcggcagttcgagtttttgtccgtccttggaaagctgggcttttgttacgattatttccagtcctttgtccaatgcctgaacctgaatccaaagaggaccctcgacagcgaattcctcttcatcatgcacttcatccatgacttcccagaacagttcttcactgcgctcgcgattgtaccagatttcttctctgtcaaaaccgcgatcttcaatatcaccataagacatataaaattttacagtatgctcattaattctttctatttccattttgccaaccttcccttctttataagatgttgaagggacatctaagctcccgatgaatagtactttactacactttacccattccgtccacatcttaaccttatagaagacagcgcaaattctttatatttctattttatgataaaacagttataaaagaaataaaaaagcattttcacaccgaaaaacaggctttctcccggttcccatcataaatagcgcactgcttcatatattagctgtacaagcaatcgatctataagcgaggtgttaccatgccgcacgattacctgctgtcccttctgcttattatcgggattgaccttattctcggcggtgacaatgccgtcgtcatcgcgatggccagccggaatctggcccataaacaaagacagcaagcgatcatcttcggaacatttatcgcagtcgtcttgagaatcgttctgacgagcgctgcggtctatttattgaatgttccttttttacaatgcgcaggcggggtatttttattgtatctcggctatcagcttctgattgagaagaaagatgcgcagcatgtgaaaagcagttcttctctttggaaagccatccgcacaatcgttctggctgatatctttatgtcgcttgacaatgtcatcgcagtagccggcgcttctcacggtgagctgacactagtagtgatcggtctcttcatctcggtgccgattattatttggggcagcaagctcgttcatgccgccatggaaaaaatgcctttattgatgtatgccgggagcggtcttctcgcatttaccggcggtgaaatgattgccggagacagcaagctgtcatttttcatggcagaacacggcatgatacagatgatgctgccgattttgaccgttgtttttgttatcctcgccagtatgatttaccagcagactgaaaaataacaaaaagcccaaaccgcgatggttttgggctttttccatgcttatcgtaagcttatatcagttggcaagacgctgtgcttctcttaattggaaagaacgcacttttcttggcaggaatcgtctgatttcatcttcgttatagccgacttgcagacgtttttcatcaatgatgatcggacggcggagcagtcccggatgctcattgatcaaagtatataagtcttgaagcggcatagattcaacatttacgttcagtttctggaatactttagaacgggtagagataatttcatccgtaccgtcttcagtcatacgcagaatctgcttgatctcatcaattgataacggctcggagaaaatgtttctttctacaaacggaatctcgtgctcttcaagccaagctcttgcttttctgcatgacgtacagctaggtgatgtgtataatgtaaccattaatcttcactcctctaattagtaggatgaacatgtttgtattctcaaattgaaatgactttaaaaaaggaatctttataggtattatactataaaaaagtaagtgtgaacagtctcctgagaaaaaaatgtgtcaatccggcaaatttacggctggaggatttttccccattctcaattagctcagctgatcgaaaatgtttttttgttttttctcatcaatgactttgagaacttcatccgttttctcgtatgattctccgtaccatttttcatctttataagtgtgaatgttttcatatgtctgtttcatcgcttcaaatatttcttcttctgattccgtcttaggtgaccagtacagaatctccattttgttcacttcattcgtagccaatgaccggcgccgatacccgattgactgcgcgtgcttgaaatgctctctttgataaaaacgcaagcgtttctgtgtatccgtgtcatcctcgtcaacaggctccacctcaagcagaatcggcttgttcttctttttcagtctgccgatcagcttgcttccgaggccttgtcctctggatttctttgacacaaacaggtaatcaataaagatgaaagagtcaaattccgcatacatcagcacgtggtactgcccctcttctttatgataaacatcgctttgctcctttaacagagcttccatatgcgcttttgatttcatttcttcaatcggaaaatattcactcagcttttcgtaccagttcattcatttgctccttatgggttcgttgtcttcacacttttagatataccccatttccgattgtttaaacaatcttacatctattaagacgtgtgatcctttaacatggtttcaatttttttaaaatggtgtgtaatcgacgtttttggtataacggtttgccgcgtcccacaataaaaattcgtcaattccttcatcatgcagcgctttaacctggtcctccacctggcgtttcccgtacttttgataatttccgctgccgagatatgatgccgtgaagtcctgaagccacggacgcgatacaggcgggtgtttcagcttggacagctttttattttccaccttcgcgtattctttgacgacattgtagggctcaagatccggtttatcaatgccgaaatagcttgtccaatggctcggataaatcatggatgaaatgacatcgacctggtctgaaattttgctgaaattctggccgataccaggcgcttccggcagcgtggctgaatagccgaaaatatcaaccgacacatccgcgccgtacggcttgagttttttcttcgcataaccgacaaaatcggtgacggcgtgaacgcgtttttgcacattgctgtctgctgtttttccgtaatcgccgtgtccgtatgtcagttcgtcatcacgtttttcaaacccttcaggaaaacggacataatcaaactgaatttcttgaaaacccatctttacggcttgttttgcaatctttacattgtaatcccatacttctttcataaacggattgacgaacgattcgccgcggccgtttttccagacacttccgtttttttctttaaaggaccactcgggctttttattcgcgagttcgctgtctttaaatacgacaatacgcgcgatcggatagatctttttttcctccagctttttcatcatcttttttgggtctttgatgtacggcttggcgattttggcatactcagaatggccgtccggcttaaaggtgaggttcccgttgtcgtccttgacatcaatcaccattgtattgagctccgttttgtccacaaagtctgtcagctccccgaatttgcttcctcccgctgaatgtcctgtgacgtaaatgccccgcaccttatcaggatgtgaaaaatgcagccctgacggataagcgaaccgtgcatttgatttcggcaattctttttcagccagtgctacttttacaagcggctgctcctctttcacagcggcatgggccggataagcggctgcactgataaacagtcccgcacaaatggcgcacaaaatggttttcatactgatctccccctttttttccattatagaaaaacgggagcaggcttaataaacttgaatgtgcgcaaaaaaatcctccaagactcagtcttggaggatgatacgtttatagataggttttaaattcagcttctgtgcacatgacaaaatgtcccggtttcacttctctgaattccattttttctccttcttggagctgatgaactgccggatcgtatttctttcgcgtgcgatttctttcatagtccggatcaggaagcgggatagcggacagcaatgatttcgtatatgggtgaagcgggttttcgtaaagctcatccgccggcgcaagctccaccaattttccgaaatacatgacgccgatgcggtcgctgatgtatttgaccattgataaatcatgggcgataaacaggtaagtaagccctttttctttctgcaattctttcattaaattgacgacttgcgcctgaatggagacatcaagcgccgaaatcggttcgtccgcgatgataaactccggatcaaccgccagcgctctggcgattccgatacgctggcgctgtccgcctgaaaattcatgcgggtagcggttggcgtgctctttatttaaaccgaccgtttccagcagttcgtgaacccgctgcatccgctcttttttcgtttttgccaggcggtgaatatctattccctcggcaataatgtcggcgactgtcattctcggatttaaagatgcgtacggatcctggaaaatcatctgcattttccggttaaactccagcagcttcttgcgggattttttcccgtggacattttccccgttaaagagaacttccccgccggttgcctcatacagccggataatactgcggcccgtcgttgatttaccgcagcccgattctccgacaaggccgagcgtttcgcctttataaatatcaaatgacaaatcatctacggcttttaccgttcctttctgcgtgaaaaaatgctgttttaagtgtttgatttcgagaagtttctcagtcatttttttcaccttccttcattaaaacaggatgctgatacgtattcggaagctgacggattttagccttcaccgcttcaggcggctcgaccttaggcgcatcaggatgcagaagccacgatttcacaaaatgcgtatcagacactttatacatcggcggttcctgttcaaagtcaattttcatcgcatatgagctgcggagcgcaaatgcatcccctttcggaggattcgtcagatcaggcggcgtacccgggatggccgtcagtttttcctgatcggtgctgtccagactcggcattgaggcaagcagcccccacgtatacggatggcgcggatcataaaagatttcatccaccgtgcccgattcgacgacctgacccgcgtacatgacggcgacccggtcggcgacattggcgacaacgccgagatcatgcgtgataaaaatgatagacgtatcaattttcttttgcagatctttcatcagctcaaggatctgtgcctgaatcgtcacatcaagcgctgttgtcggttcatcggcaattaacagtttcggatttgccgcaagcgccatcgcgatgacgacacgctgtctcataccgcctgaaaattcatgggggaattggccgatccgtttttcgggcatcggaattccgacgagatcaagcagctctatggcgcgctttttcgccgcttcacttgagattttttcatgtttgaaaagcacttccgtaatttgcttgccgactctcatcgtcgggttcagagaggtcatcggatcttggaaaatcattccgatgtcctttcctctgatggcctgcatttctttttcggacatcggcacgatatcgcgtccgtcaaaaagaatctgtcctcttttaaagtagcccggcggcatcggaatcagcttcataatcgcttgggaggtcacactttttccggaacccgactcccccacgatcgccagcgtctctcctttattcaaatggaaattgacgccgcggattgcctgtacctctccgccgtatgttttaaatgaaatggctaagtcttttacttctagcaaacgtgtcactcatatcactccttatttgcgtaacttaggatccagcgcgtctcttaacccgtcgccgacaacgttaaagccgaacatcgccaggcagataaagccggcagggaagaacagacgccaagggtaataggttaatgcaggcaatccgtctgaggccatcgttccccagctcgcaagcggcgcaggtacgccgaggcccaaataacttaaaaacgcttctgtaaaaatcgccgtcggaaccgtcagtgtcatcgttacgagtatagagcccatcgcgttcgggacgatatgcttaaacaaaagccggccggttttggcaccgagtgtctgtgaagcaagcacatactcctgattctttaattgcagcacctgtccgcggacgatcctcgccatattgatccagcccgtgatcgtcatggcgacgataatggtgagcaatcctttcggcaggacaaccatcagcaaaataaccattaataatgaaggaacagcccacagaatgtcggcgatgcgcatcatcacttcatctgtgcgtccgccgcggaatccggaaatgctgccccagattacgccgatcaataaatcaagcacggcagctgcgacaccgataaagatggaaatccgcgcgcccacccatgtccggacgaatatatcccttccaaggtcatccgtgccgaaccaatgatctttcgacggcgctttatccgcatttaatagattggtagtggcataatcataccttgaaaagataggcgcaaaaatcgccatcagaataataagaacgatcagtacgaacccgaccatcgcaagcttattgctgcggaagcggagcatggcgtctttccagagggaaaggctttttttatttattttttcggcatcgccggcattagctgaagctggttcaaacatatttttaggaatgttctgcatggtctaggctcctttctttgctttggaaagcttgattctcggatcgattaatccgtacagcacgtctacaattaatacgcatagaagcaggagcacgctgaagaacacggtaactcccataatgaccgtataatcacggtttgtaatgctgtttacaaaatgcgcgcctaaaccgggaattccgaaaatggattcaatgatgaaacttcccgttaaaatggatgccgccatcggccccatatatgtcacgaccggcaaaagcgcgtttcgcagcgcatggcgcacggtgactgacggacgggacagtcctttagcttttgcagtccgtatgtaatcgctgtttaacacttcaatcatgcttgaacgggagagtctggcaatgaacgccatcggcatggaagcgagcgcaatggagggcagaaaggtgtatgcccaggattcccatcctgcgaccgggaacagttctaatttaattgagaaaatatattgcaaaatcgtcgccaatataaagctcggaactgagatcccaaagatcgttaaaatcgcaatggtataatcctgccatttattatggtacagggcagcaagcaccccgaaaagcacaccgaacgctaaagcgaggagaatagcttctgcaccgagagtgaatgagacggggaagcctgaattgattaaatcattaacactttggcctttatatttaaaagaaggcccgaagtcccacatcgccacagattttaagtagctgacatattgaacgaaaagaggcttgtccaaaccatagtgttcgtttaagtttgcctcaatttcaggcggcagctttctttcgccggaaaatggtccgcccggcgctgcctgcattaagaagaacgtggcggtcacaatcacaaacaatgtgatgatcatgtaaatgaatcgtttaccgatatatttcagcaaggtgaacacctccatgttttttacaattttatacgtaatcagtaagaaaggtatatggggacatcctccccatataccttgggtcttttgttttcagaaccggcttttattcaaaagaagcgtttctgaagtaaacttcgcctgttcctgtcaagatcacatttttgaggtttttatcctgcacccaaggatccgtatagaaataaactggcgcgaccggcattgcgtcgataaagatcttttctgcttttttcagctcttcgatacgtttatccggatccgtttcaagctgagattggttcagcagctttttaaactcaggatcttcccacccggtatcattgtttccgccttctttatcacggaacaattcaaggaagttgatcggatcgttgaaatcgccgagccagcccatacgtccgatttggtagttttggctgtgcagcttgtcgatgtaaacattccattcggagttatcaagttcaactttgacgcccaagttctttttccacatttcctgtacggcctgcgcgattttcgcatgcgcgtcatccgtattgtaggacagcttgatcgccggaaggtcagaggcactcttgacgcctaattccttcagtcctttatttaagaattctttagctgatttgacgtcattgtctttgaagtaaccttttgtgttatccttgaatcccttcattgacggcggcaccgcagccatggccgggatttgttcgccctgcgttacatttttcacgatggacgagcggtcgatcgcataagcaagggctttacggatgttaacattgttcagcggtttcgcttctgtgttgaatttgtaccaatacacgcctgcgatcggttcaacgtgaagagatccgtcttttttcaatgtcggcagagattcagtcggaagctggccgagcggcattcctgcccagtcaagctcaccggcctggaattttttcagttcggtgttgttattgttaatcatcaccatgttgattttcttcaatttcacagcgtctttatcccaatattgatcgttcttttcgagcgtgatggaaccgctgtgtttccaggccgtcattttgaacgggccgtttgacacataattttcgcccgcgtttgtgttccagtttttatgtttttcggcgattttcttgttgatcggcatatacgtatagaatgaagttaattgcgtgaaataaggtgtcgggttattcagttcaacctttaatgttttgtcatttacggcttttacgcctacatcatcaatcttgccttttcctgtattggcagcttcagcgcctttgatgtagtagagctgataagcgtattgtgattcgttgttcgggtcaagcacccatttccatgcatattcaaaatcctgcgccgtcacagggtcgccgttagaccatttcgcaccgtcacgaatcgtaaatgtataggtctttccgtctttgcttgtttcaattttagatgccattccttcttcagggtcacctttggagtttacgcgtgtcaatccttcaaaagtctgtcggattacgcctcctgaaacggaatcattcgctaaacccggatgcaatgagaacggctcggttttaatattgatattaagtgaagtctgtcctttggtgtcttttttgccgccgcctgatccgccgctgaatccgccgcacgcacttaatacaagcgagaagataagcatcaaacctacaatagaccaacgctttttcatgcactaaccccctaatcaaatttttcagcctttactactaaatactcagaaatatcagacaaaataacttaatatttttctaaactttaattgtgttccgtcttttctgattattttatgtaaagaagctgtaacaatagagtgaacaagttcattataatgaaatgaataatttattgcaatactattttctcaatttaaaatatttaaatttggtcagtttttctgtcaaaaaggtgatacacttctatagtttaaagcatgacctaactaaatttttttaatgtaatttccagttcatattgctttttacatataatattcgttatacgaaatgttgatatacgttatcatttaagctttttcagttctttttgaggatttccacccctaaagtaaactggaaataagcttgtattcctctgatgacatttggctataattgatttataatagatcaatcaaatacatttgttgtgattgcgatgatgaagagtagtacacattttcatccgtttgaagagagtctgcggtgctgggagcaggtaacgggcgatgtggaatggacttctgagcagctgaccgaacgttagtaggcccagccggagcagcctccgttaccaacgtctcgagcgattccattgtaatggaataatcagggtggcaccacggttcattcgtcccttttttctacgggaagaatgggctttttttattatgttttaagaaatgaggtaagaactatgaagaaaacgattttttcaggcattcagccgagcggttccgttaccctcggcaactacatcggcgcaatgaagcaatttgttgatttgcagcatgactacaacggctacttctgtattgtcgatcagcatgcgattacagttccgcaggatcggcttgagctgcggaagaacatccgcaatctcgcggctctttatctggccgtcggacttgatcccgagaaagcgaccctctttatccagtcggaagttcccgctcatgcccaggcggggtggatgctccaatgcgtcgcatatatcggcgagcttgagcggatgactcaatttaaggataagtcaaagggcaaagaagccgtcgtgtccggactgttaacctatccgccgctgatggccggcgatattttactgtacggaacggatcttgttccggtcggagaagaccaaaaacagcatcttgaactgacccgcaacctggcggaacgctttaataaaaaatacaatgacatcttcacgattcctgaggtgaaaattcctgaatcaggcgcgcgcatcatgtcactggctgatccgctcaaaaaaatgagcaaatcagatccgaaccaaaaggcattcatcacgctgcttgatgagccgaagcagctcgagaagaaaatcaagagtgccgtgactgattctgaaggcattgtaaagtatgataaagaaaacaaaccgggcgtttctaatcttttgacgatttattctattttaggaaacacatcaattgaagaattagaagctaaatatgaaggcaaagggtacggtgaattcaaaagcgatttagccgaagtcgttatcggcgcattgacaccgatccaagagcgctatcgtgaattaattgagagcgacgagcttgaccgcattctcgacgaaggggcggcgcgcgcaaacaaaacggccggcaaaatggtgaagaaaatggaaaacgccatgggtctcggacggaaaagaagataaaaaaaagaggcgggagaatccccgcctctttttttagttcacttttgattcctgttccatttcccaaagcttttcgaaaaacggctgccctttaatcaaattttcacagaacgcaagatgtttatccgaccagccttcaattgtttcattgtaaagcatgtcccagatctcttcaaaactcatccgtttgatctgctcatacatatgcggattccattccgtgtaccaatacacaatttccgcacggtttttcagccctttcagctggtcgagcgccataaacatcagctgcttgatctgccgctcttttctcgtcagacctctgacatgccccggcgccaatgacaaaatgtgatattcctttgaagactccaattgcgacggctcaaattgaaacgattccggttctacatcctttaccatttcataaacaagctgctcctgtctcggaatcaggcggctctttctgaccggaatggtatacccgatcgtatccacggcaatgatgccgatcccgtctgtcacgacaaaacagtactccagctttgtccgctcatgattttttcgcacgtatgacttctggtggacttggtcaagcagctctttcggaagctctgataagtcgttttctatgtaatgaaataatactgacggcactctgagcagcggcgtctgatccaaaagctcaaccgtgtcttccttccgccattcgtgaaaatggcatacattgtagccgttttcttccccttcaaaccaattgacccatacatcatgaagaaataacatattcgacccctcactttataaaaactgttgtccacagtataggcaagggatagataaattattccatttcaatatgagatttccgttttacggagctggatttccgactgcattgcaacaaaaaaatctcccgttcgtccgggagatcatttcacatttttcggatcaagcgcatcacgcagcccgtctccgacaaagttgaagcacaatacggtaagaaggatcaacaaacccgggaataacgggtaccaccaagcctgtatcataagcgtaaagttctgtgcatcctgaagcatattgccccagcttgcgatcggcggctgaatcccgaaaccgagataacttaatgtagattccgccaaaataaccgttcccacctttaatgtggctgagacgataatcggtccgagcgcattcggcagtatatgagaaaagatgatgtgatggttttttgtaccgatcgtctttgcagctaatacaaactctctggaacgaagcgataaaaactctcctcggacaaggcgtgccgttgttgtccagcctgtaagggagaaaattaaaattaatttatccattccgggctgaaaaatcgtaacaagtgtaattaacaaaaatatatcaggtatggataatacgatatcaacggttctcatgagaacggcatcgacaaaccctttaaaatatccggcaacggctccgacaactgtcccgattgtaatcgcgccgatcacagaagcgaatccgacaagcaaggagacgcgcgccccgtacagaaccctcgtaaagatgtctcttccgaatttatcagttcccattagatgttttaagctcggcggcttcaaacgattgatgagagattgactctccggagagtaaggagcgattaccgaagcgaataaagctgacaagataatgatggttaatataacggctccgattacagctagtttattttgaaagaacttttcgaaaaaaatcttcgtcattgtttccggtttggattgaatattttcctttaatttcacttcgctggggggtgtgccggtatttggctgtaacatttgacctctcacctctctttgttaatattcaatgcggggatcaaccagcgcatataagatgtccgcaattaaattccccactacaaccaaaacagctgaaatgaccgtcatggccatgataaccggataatcccgcgaaaaggctgaatcaataaacaatttgccgagacccggccaagtaaaaatctgttctaccactaccgctcccccgataaatgacggtatcatcaaaccaaaaatagtgatgacaggaagaagcccgtttctcaaaccgtgtttaaaaatcactttattatctcggaatcctttcgcacgcgccgttcgtatataatcctgttttaacacatcaagcatactggatcttgtgtatctcgttatccctgccatgtctgccgtggcgagcacaaaagcaggcagaatcaagtgatgcaatcggtcaaatatgttaaagtcagcattcaaagtgcttactccgccagtgggaaaccaccccagatttacagataaaaccatgattaaaatcaaaccgaaccaaaaattcggaatggcaagccctaaaaatgaagtaacagttatcccgtaatccaattttgaataaggacgtttcgctgacagaacaccaaatggaatagaaatcagaagagcgacaagggttgagaaaagcataagcacaatcgtattcggtaagcgggataagataagttcagaaaccggagtgcctttcttgacgatagaagtcccaaaatccccttgcagcatattccccagccatttcacatattgaacaggttccggatcattcaacccgtatttttcaatgaatttcgccctgtccgcttgactgattgtagggtccatcataagtgacatcgggtctcccggcgctgctttcatgatggcaaacgacaaaattgtaatgcctaagagaatcggcaaggacattaatgttcgccgtaaaatatatgtaaccatattcttgtcccctttttaaataggataagagaggaaaggaacctccttccctctccagggcttttgctatttttgatccagccaccatttttcaatattgtacaagtcatttttagggtggaatacatagccttgtaaattattcggcatcgctctgtggtaattgtaatagaataagaagctgtacggctgatcttcagcaattaatttgtatatctcttcatacttcttttggtattcttttctgtctgtaattgacttcgcttcttcaagcagcttatcgactttcgggtttttataccagatattattcagcccgtttttcgattggcttgaatggaagatagagaattgatccgggaacgttgcaagactccatccgagaagaagagcgtcataatcccaattaggggcacttgtctgttcgattaacgcactgaattcaacaattcgcggtttagcctcgattcccacttcttttaattgctgctgaacgacaacagctaaatcttcacgaattttattgccttgattcgttttaatttcaaatgagaatttttttccgtctttatcaaggtagccgtcaccgtcatggtcttcccatccggcttcttttagcagctgctttgcttttttcggattataatcaaatgtcggcactttagacttcggataattccatgacagcggactctcaggaacatccgctaccttaccgtctccgttcagcacttgatccaccattgcctgcctgtcaagagcgtaagtcaatgcctgacgcacttttttgtccttaaaaagctcttttttctcattccagccgatatagctgtagtttaagccgagatcagatttgaccttcacgtttccaaacgttttaaccgtatcaaaatctgtgcccggcacaacgaagaaatcaatatctcccgcttttaactgggccacggccgcgttagaatcaggaattgttttgactgtcactgtatcaaggtaaggtctgccgccaaagtaatcatcatttgcttccagtttgacatactcaccttttttccactcaacaaacttaaacggaccggagccgattggatttttacggttaaattcattctctcccagatctgcaaccggcaccttacccaatatatgttttggcaaaatgccgtaactgtcgagaacgacattatagaaataggcatcttttttcttcattttaaactgaatttcatattttccttttttcgttacggatttaagggactcaaaacccgagccacgctcaccgttgtaatccttgttaagagggatgctgtaggtgaaaacaacatcatcggccgtcagctcttttccatcatggaatttaacgccttttttcagttttacatcatacgttaatcccccgtcagcttctgttactttttcagccagcgacggcttgacgtttaatttctcatccgtttccaataatgtgctgtaaatcatgccttcaatatcagaacttgcaacatcggtagaataaagtggattaaaaagtgtgggttccccggttgacccgacaaccaaatctccgcctttttgcggttttcctgccggtttggattcggtgcttgtggattttgagccggagcaggctgacaggaagatggcgagcgccataaaaacacttagcatcatcagtgcgcttttacgtaatttcatatcaattccccctttgtgatatatatgcagcaaactggttatgtaatccggcataccccctctcgatgcttgtcatttcaggcatataaatggcaggcgacgtaatggccgggagcggcttcttcaaatgccgggatttgttccttgcagatcggtttggccatcgggcaccgcgtgtggaacacgcagcctttcggcgggtttgccgggcttggcagttctcctttcaggatgattcgttcccgcttgacggcgtctttttttctcgtgacgggcactgaagacaaaagcgcttgcgtataagggtgaagcggattgccgtacagctcgtgtttatcggtcagctccatcatttttcccagatacatgacgccgactctgtcgctgatatggcggacaacactcaaatcatgagaaataaacaaataggtcaggttgaattcatcctgcagttcttccatcagattgatgacttgggcctgaatggagacatcgagtgcggaaacgggttcatccgcaataatcagctcgggattcaacgtcagagcccgcgcaatcccgatccgctggcgctgccccccggaaaattcgtgcggatagcggtttgcaaagctcgggtgaaggccgactttcgccagcagctcctccactcgctcgttccgctcgctcatgctgtacatatggtgagtctggaacggctctttaataatggaacgcagcgttttcctcgggttaagggatgcgaagggatcttggaataccatctggatgtttttgcggacgctttttctcagcttttcttcagataagccggagatatcttgccccttaaagagaatccggccgtctgtcggcttgtataaacggatcatcgtccttcccgccgttgatttgccgcatcctgattcaccgacgatgccgagcgtctccccgcgcttcagtgaaaaagaaacgccgtcaacagcctttatatcaccgactttcctttgaaaaaaaccggagcggatcgggaaatatttttttacgtctttcagctctaaaatcgtttcttggcctgcagctgtcattttgattgggcaccctcttcctcatataaaaaacatcttacagaacggccgctttcatgcgttatcagctccggctgccctgttttgcatttgtccatcgcttttgaacacctcggggcgaatcggcagccttccggaagattatccggtgtcgggacactgcctttgatcgcttttaatgtatcaatctctccatctatcaccggtatggagtttaacagcccttcggtatacggatgaagagggtttaaaaataagtcctccacacccgcactctctacgacttgtccgcaatacataacgatcaccctgtcggcggcttcggaaaccacacctaaatcgtgagtgatcagcagaatagaagtatcgaattttttgcagaggtctttcatcagctccaatacttgggcttgtatcgtcacatcaagcgccgtcgtcggctcatcagcgatcagaagcttcggattgcagctgagcgcaatggcgatcatcaccctctgtctcatccctccggaaagacggtgcggatattctttcatcacttgttccgctctggagaatccgacgagttccagaagctcaacggcttttttagccgcttcttttttattcatttttttatggtattcaagcacttcggtaatttgttcgccgatggtcagcaccggattcagggaagtcatgggctcctgaaagatcatagagacgtcatttccgcggattttgcaatattcgttttcggtgaaggaggccaggtccctgccttccagcttaatcgagccgtccataatttttccgcccgagctttggacaagtcccataatagaaagcgaggtgatgcttttgcccgagccggattctcctacaagagcgacggtttcgcctttgttaatgtgaaaatcaaccccgtcgactgcagggatcggctgtttctttctgaaaaaataggtctttaaattattcacttctaatagtgtgctcatgatacgcccctttctcattccgctgaagcagagggaaacatacgtttcgctatcacaaaatatagaatagtcgaaaaattttatagttgtatattattacatcattattacaaaagcaagaattttttaggataaatgtaatatccttaaataatttccattcttttaatctattaaagcgttgcttccagaaaggtttttgaagggatggccaatgcttcttttactgttttttgatggtcggttaaatatttttttactatattgaatccgacggcatagccaagcattgaggggaagtatccttttccgtataacagctgggaaaacattctgctgtctctcgttaagcggaggttcggcttgactcttttttcaaacaaaaaatcaagctgctcaggcgtatagtaggacgtccattccgccgtaagacttgagccgaaccgctcatatacagcatattctgccagcccctccatcatgattgtatcaagaaatgtctcatctttttcgtcctttgtcacatgttctaaccggcagacgtgattatattcatgtgtcataagggcggatacagctgaattggaactatccgacgatagaaagaggaacattttgtcccgaaaggccagaccggattttgatccgaattcctgacggattttccggtttcgttcatcaacgggcaaaactacgatcggcacgtccggcccgttccacttctcctttaaataggcttcctctttttgtatatggctgtagcatcctttttctttcagccgtttactggtcctaacgccgtccttcagatggcggaacatgccgtggttttgcagcatcccgagtatcggcttccactctttcttatcggcccctgaaaaaagcggcaaaagatgcggggccaggtcatttacggatgccgccttttccatccattgatatgtctgcttgacgctcataccggttcgcctcctcttgttgttatcatatgcacgcacaaaaaaaccggccacctttttcaggcagccggtcaaaaactgtattattgatattttttaaagatcaaagtggcattatgtccgccgaagccgagcgagttgctgagaacgatgttgacatcctgctcgcgcgctttatccggtacataatctaaatcacactcttcatcaggtgtttcgatgttaatcgtcggcgggataatgccgtctttaattgccatgacggagaagattgcttcaattcctccggcagcgcctaacaaatgacccgtcattgattttgtcgaactgacggcaagcttgtacgcatgatcaccgaaaacggtcttaatggcttttgtctcgtatttatcattgtagtacgtgcttgtgccgtgagcgttgatgtaatcaatttcttcaggcttgatgcccgcatctttgattgcttcctgcatcgctctcgcaccgccttccccgtcttgggcaggcgcggtaatgtggtaggcgtcacccgttgagccgtagccgacaatttccccgtagattttcgcaccgcgggcaagggcatgctcaagctcttcaagcacgacgatccccgcgccttctcccatgacaaagccgtcacggtttttatcaaacgggcggcttgccgttttcggatcaggatttgtagaaagggctttgtttgcgctgaagcccgcaaatgacattcttgtcagcggcgcttccgttccgcccgtaatcatcgcatcggcatcgccgcgctgaatgactttaaacgcgtcaccgatagagttcgttcccgtcgcacatgccgtcaccgtacaggagttgactccttttgctccgagagcgattgagatttggcctgtcgccatatccggaatcatcatcggaacaaagaacgggctgacccttctcggcccttttgtcaggaagatttcgaattgggattcaagcgtttcaagaccgccgattccggacccgacccaaacgccgactctcggagcgatctcgtctgtgatgttcagaccggcatcttgaacggccattttcgcggctacgacagcgtattgcgtgaagcggtccatttttcgcgcttcttttttatccatgtgattttcaatattgaaatctttcaattcagcagctactttcgccggatactcgtccgattccacacgtgtgatcggtccgattccggatacgccgccgattgcatttttccagcttgtttcggcgtcgttgccaagcggagacaaggctccaagccctgtaacgactactctttttttactcatcttgtgtgcacctcacctttttttatcgtccccagcgtaatgctatggcgccccatgtcaatcctccgccgaaaccgaccatgacgatgacgtcgccgtctttaattttgcctgcttccagttcctctactaatgaaatcggaatggatgctgcggatgtgtttccatatttatggactgttttagacatcttttcaaccggaagctccaaacgttcccgtgccgcttccatgatgcggatgtttgcctgatgcggaatcaaaaagtctacgtcctctttggagaggccggctttttcaataacatttacactcgattcacccatttgccggacggcgaatttgaatacttctcttccatgcatgattgtatgccctttttcatctaagtacaagtgctgaccgcctgtaccgtctgctccgagctcaaatgaaagtatgcctctgtcgtcgctgaccggtccgatgaccgccgctccggctccgtctccgaacagcacagccgtattacggtcgtcccagtcggtaatgcttgagagcttttccacgccgaccacgaggacatgtttgtatgtttgcgattcaatgaattgtttggcggttacaataccgtacataaaacccgcacatgcggcgctgatatccatcgcgcacgcttttttggccccgagcttctcttgtatcatacaggaaacggtcgggaaagactggtcaggagtaaccgtcgccacaaggatcatatcaagctcctcagcggaaatgccggcctgatcaagcgctttttgcgcagcctcagcggccatgccggatgaatacatatcttcagcggcgattcttctttcttctatacctgttctcgtacgaatccactcgtccgatgtatctaccatttgttcaagatcatgatttgtcagcactttttccgggatgtaacggccgacgccaagaattccagctttcattggaaaagactccttttttataatgaatttaaaactaattagttatgatcaattattagtatcaggtactaattctaccctattttttttctgttggcaatatattcgtctaaactatcggacgctgctcctcatagaataaaaggaagacgaaaggaggcttcactatggatattttctccaaaatgatgttcggcgattccagagaccgggataaagaaccggaagaaaacccggagcagcctcaggctgaaaacgaagaagagatcgattacaaccacgtgttgaatcagctggggtccatcatgaactccctggatcaattaaagcccgtatttaaagactttgcgccgatggtgtccgccataaagaaaaaaatcatgtgaaaagccacttcatgaaaaagtggctctctttatttattcagctccccggcatcagatctgccaagctcatacgcttccgccatgaccgatgtaaacaggtccataaacggctgaatcatttccatagacagatctatgccggatttctcaagctccgcctttgcttccggcaagtatttcatcgcgatctgcataaattcaagagacttttcatgctgcatgtgtatccacctctattcatttgacggcagttcatttgtttgattatacgttttgacaaggtctgagattttgtcttgaaacgctttgtccaccagcgggctgaacgtccccatttcaacgactccttccctgaaatcaaagtcgtgatctccgctcttgagcgtacctttattatattgctcggcaattaatgtataggctttatctacgttttgcaccgtgcttgtcagcaccgtgtttttgccgagattcgattgctcggcgacatagccgatggcgtaaagcccgtcttttttgatttgctgaatgacaggaacattatacccgtctccggccggatatacaacatccgtgccctccgcttttaacttctcgtaaagatgcagcgcttcattgccgttatcccagtggtccgtaaattcagtattgacggtgatatcaggcttttcatatttcgcccctttgataaagccgtctacttcaggctgccacaaaaaggaggcgatgacaccgacctcattggtttttgacatatgggcggccgtcattcccccgaaaaaacccattgcttctcccataaggtgaacgcttgtgacattatcgcttttcgccgttccgtttgcgacgacgaattccatgtcgggataatccttgctgatcatattgaagatttcctcgtattcatttccgtgcccgtataaaagattgactccttttttatgaaaatcatctatcgcttttaaaatatcttcatcggatctgatattttctttataataaacgtcaacgttaaattcagattgtatcgctaataaacctttgtaaccttttgtgccccataccaagtcactgatggtatcggggaaaagcattccgaccttctcaatttttcctttaaacggagtttgtgtgcatccgctcaataaaaggaggacagaaaagatcatgacaagcctggtgatcaagccatgttcaaccccttttcaaactcataacatgtataattgatatacgtttattgtagcggtaatgcacataacatggaaggtatttcttaaaaaatgtcgaatattgatgaaaattgtcttttccattctttaattttttcttccgcttccgttttttgcgttttttcttttatttccagggtaataatctgattttcgtcttctgtgccgtcagcctcaagcttattcatcagcccccagaccgcgtcttctaaaaagatcctgctttctccatcttcttttgcttccgtccacggaccgtaaaggggaggaaggataatcgcttttgccgtatcccgctgaccgtttttttcccagtctccgtgatcctcactgtaaacaatccaatataaaggctcagcccttttttcaggcagacacccgctcccgtattgaacgcagatacgatcgtattccttttcaccgatttcctctattatttgaaaaagcccgtttctcgcgagccacattaaacgttcttctaaatacagctgcctcgttttgtcctccggttctgccaaaatgacatcaacgtgcacaccttcatccatcaaccgttcgcacaatgaaaggccgagaaattcatctgctccaatgatcagcgctgttttcatcacatctgccgcctttccggtttttcatacacacacaagccaaacagccctctgaaaagagatggctgttgtattctattcattacaggtctttttcatgactgcggaaaaaccggcagatggctctgtacatacgagcagggttctcaagcaggtgatacgtgatatcaatcttgcttccggtcttttcccgggcttctttatacgcgttcgcgtgcagggtgtacgggtacggcgctccggtcgttctttgccatatatgtaccggcacgcgggtgcggcagccggtaatggtctgatagctcagtgagcttgcctctttttcagaaacaccgaagctttgtgccgtttccctcagaaactgcttataaaaaaacttattttctttctctgattcaaaatgggcttgaaggtccagacaaggatctaacattgcggctgaacggatatgctccggtgaagactgcagcaattgatcggcgatgagggcgcccatgccttctgcgagcaagtgtattttcggattgagggtttcttgtttcagcacataatgaatcagctgtctggcgtaaagggcggctttttccgaaccccaatgccgtccgtataaattgctgttgaaaatggtgtaccctctgtcaagcagcgtatttaacagctggtttctcccttcatgttcgagccaaaagcttgagtcccggctgacaaagtgagttctgtcccccagaataaagatacagaagccgttcggccgatacggcagatggatgacgttcagctcagatccgaattggaaaaatctttccgttatccccatgcctgcccgcctccttttactcctaatctctctattggctatcatatgtaagaagaatgaaaacggatcggataaactcctatttgctgctatgttttggctattatcccaagcacaggaaccgaattttccgtcagacggcaagacaggcgggcacatgtcagtttcaggcgcgctttttgatgagaaaatgaccttccgcccgcgctttatgtatggtatgatacaacgtagaataaaatgaaggacgaggtggaaacgtgcggtttattatcggttttatttggacgttccttttaacacatatggcctgttatttggtcgcctccatgaacagcgcggcgtacaatttcaagcaatcatccgttattgccgtggttattgcggtgctagtctttgttcttgcggagatcatgcctgtcaaacaggatgcaaaccagcattaaataaaaaacctgctattcagcaggtttttttgtgttcacggttttcgttggtacgtccacaatctgttgtggtttgaagtttcagggaacatttctcccaccgtaagtttgattttttgcggatttttgaccatgcttcccgtttcgccgatttcaacgtacacaccgttattcggcgctttttgtcccgggcggaattgatgctgctgtcccacgtcatttcctcctttttcttttttatgtagtatgcgcttgtatgcggagaaatatcaaaaaccgctgaatgagattcagcggtttttttgttcatcctgtttgtatagaagagctttcaggagcgctttttgcgcgtgaagccggttttccgcctgctggaataccgcagagttcgtgccgtcgataatctcggacgtgacctcttcttcccgatgcgccggcaggcaatgcaaaaatgtatagtcgggtttggcgagactgacgagtgaggcgttgacttgatacggagcaaacacattcagccgctgctgcgtctcttcctcctgccccatgctcgtgaagacgtcggagtaaatcacgtctgcatcccgcaccgcttcctgcggattttcggtaagggtgattttcgctccggaaacagccgctgcttctttcgcggcattcaccgcctcttcctctgcttcatagcctttcggcgaagcaaccgcaatgtcacagcccatttttgcgcagccgatcataagtgaatgcgcgacattatttccgtcaccgatataggcgacttttactccttttaattttccttttatttcttgtattgttaacagatccgcgagtgcctgacacgggtgataccggtcggtcagcccgtttatgacgggaatatcagcatgctcggcaagctcttcgactttttcatgctcaaaggtgcggatcataatggcatcaacgaagccggacagcaccttggccgtatccgcgaccgtctccccccgcccaagctgcaggtcgctgcttgaaagaaatagtcccgttcccccgagctgggccattcccgcttcaaaagacacacgtgtgcgggttgaagatttttcaaaaatcatcgccaatgttttcccttggaaaatcggctgtatcggatgttgttttaataatgaagcttctgtcagaagcgcattgatgtctgacgggctgacatcttttaatgaaagaaaatctttgccgtacaaatgggttaatgtgtgttccgcttttattgtgtgcatgatgccacttccttttgataaagatctttgagcgatacaggctgaggtttgccggagccgcttgctaaaaatgcctttacggtttccggttcagtaaagaccgtcacaccgtgcgtcatggcttcgatccgttgtttacgcgcttcttcagagtgattgaaattaatatggaccgctttatcctttcgctctgcccatgccgggaacgcatctttgcatacggtaaatcccgcctcttgagcctgacgttccaattccgcatcacagccttccagatagatgctgccttttttctcccagacgtgcgcgtagatttttttcagtgcgctttctgcgtcaaacgcgacacacatgccttctccggtcgacttcatttccggcccgggctttacgtccacatcctgaatggcgtgagaagaaaaaaccgggaatttcactgccgttccgtgctgattttgaacctcgggcttgatgtctttaagggaagcgccggccagcaatctggcggcaagcgggatcatcggcacccccatcaccttagacacgacaggaaccgtgcggcttgcccggggattcacttcaagaacgagaatatcccctttgtcatcaatgacaaactgaatgttcataatgcctttaaaagccagttttaccgcgattttttcggcggcctcttttatattccgctgcatatcaggtgtgacagacggacccggaagaatcgcaaaactgtcgcccgaatggacgccggcccgttcaatgtgctctgtgtaagtcggcacgaatacttcatgtccgtcggaaatcagatcgatctccaattcttttcctgtaatgtactgatcgatcaaaatcgggtacggcatgcccgcttctttttccaggagctctgacatttgcgcttctgaatgaacgatgatcatgcccatccccccgatgacataagacggacggatcagcacggggtagccgattcggcttgctttttcagttgcttcttcttttgaataagccgtttcgcctttggcatgtttgaggtcaagatcatcaagcagctgataaaacagatcccgatcctccagcgcatcaagggtttcaaaggatgttccgagcagcggaatgcccgctttttccagcggttcagcggcattgatcgcggtctgtcccccaaactggacgatggcaaaatcaatgttttcatgttccgccacgtttaaaatatgttctgtcgtcagcggttcaaaataaagccggtcggcgatttcataatccgtgcttactgtttccggattgttattgatcataatcgtttcatatcccagcttttgcagggtcagaacgccgtggacggcgctgtaatcaaattccactccctgaccgatgcggatcgggcctgagccgatgatgagagcgcgttttttctcttttcggctgacatctccgtcgctttccccaaggtaggtggagtagaaataattcgtcttggcatcaaattcagcggcgcatgtatctacgattttaaacgacgggacgatgcctgatttctttctgagagcacggatgtcttcttccgtttttcccgtgagagatgcgatcatgacatccgtgaagccttttaccttcgcctgctttaaaagcgggacagacagatgatccccttcttccatcagcttgttttctaatgtgatgatatttcggaatacatggagaaaaaacgggtcaattttcgttttggcatggatatcttctatcgtttcaccgcggcttaacagttccatgacgacgaaaaatctccggtcatccggcgttaccgctaattcccacagctgattgatcgtacagccgccgagttcaggcaggcgggtgccgatcgttttcagctcaagggaggccgccgctttttgaatggccgcttccatatttctttcgatcgccatgacctctcccgtcgctttcatcttcgttccgagcgtgcggtcggcatgtttaaatttatcaaacggccagcgcgggaatttgacgatgacataatcaagcgccggttcaaagcttgcataagtagagcccgtcagcggatttttcagttcgtcgagcgtatagccgacggcaagtttcgccgccattttggcaatcgggtagccggtcgcttttgacgcgagggccgatgaacggctgacacgcgggttcacttcaatgacatagtactgtttgctgaacggatccagcgcaaattgaatgttgcagccgccgaccacatccagcgccgaaataatcgccaggcttgcggaacgcagcatctgatattcttcatccgttaacgtctgggacggtgcgacgacgatagagtctcctgtatgcacgccgacgggatcgatgttttccatattgcagacggtgatgcatgtatgattgctgtcgcgcatgacctcatattcgatttctttaaatccggcgatgcttttttcgacgaggcattggctgatcgggcttgctaacagcgcctgtttaataagcgtctgaaacgattctttcgttttcgcgattccgcctccctttccgcctaatgtgtacgccggtctcagaataaccggaaatccgatagactcagcgaagcggagggcgtcttcttcgttgtcgacgatttcgctttccggaacgggctggtcgagctctttcatcagggcgcggaactgctcccggtcttcgcctttttgaatggtttccaccgatgttcctaagagcttgacgtgatgcttcttcagcacgcctgcttcttcaagtttaacggctaaattcaatgccgtctggccgcccaaattggcaagcagaccgtcgggcttttctttttcaataatggcctcgatgctgtcggttgtgagcggttcaaaatatatttcatcggcaaacgcctcatccgtcataatcgttgccgggttgttattgactagaataacgcggtatccttcttctttcagagccatgcagccctgcgttcctgaataatcaaattcagccgcctggccgatgatgatggggccggagccgatgactaatatgctggaaatggttgtatctttaggcatgagcgatttctctccttgctggtatcactttctctagaaattcatcaaatatccactcgctctcagccggaccgggatgagcttcagggtggaactggacgcttaatacgggaaggcgcttatgaatgagcccttccactgatgtatcattgacatggtgaaatctgatggacagctcgttttcgtcaattgacgcttcatcgacgacatagctgtggttctggcttgtcataaacacccttttcgttttccggtcaatgacgggatggttggcacccctgtggccgaacggcagcttatacgtatttcctccgaaagccagggcaatcagctgatgcccgaggcaaatgccgagtgcagggaaatcactgagtaaagatgtaatccggttcatgtacggcgcaatcgctttcgggtcgcccgggccgtttgagagcacgattccgtcaggctgaatgtcataaacggcatccatctgctgatacggaatgaccgttactttacagccgcgctttacaagtgacgaggcgattgattttttataaccgaaatcaatcagcgcaatatgccggtctccgttccccattgaagtgatgtcttcagactgcgccagctccgccggattttgtgttccggatgctgcgggaatttctcctgctgttgacacagcagcgttcatcgtgccgccggagcggatggctttgacgacggcccgtgtgtccacttcggttaagagcgggatgttccatttatttaaatactctctcaagcttgagactgcttcatggtgagaaaaatgttcacacgcttcatagacggcaacagccttgacttgtggaattttactttcaaggtctttttcattaattccgtagtttccgatcagcggatacgtaaagacgatgatctgccccttatatgacgggtctgtaagcacttcctgatagcccgtcattccggtgaaaaaaacagcttcgccaacacagcaagcctctttttcaagttcaccgccgaatgatgttccgtcttccaatactaaatagcctttcatctaaagcccacctcttgatgaataattaattaaaaatatgaatttttatacctttatatcgaaaaaaattaccgtttcactgccgaatgcgcttcgatcgctgctttcagcatactgacggccgacagcatttcttcttcagaaaccgtaagcggcggaagcagcctgatgacattcggtccggccggaagcacgagaagcccgcgttcctgcagatctccgatgatgccggacacgggacctgcgcattcaatgccgattaataacccttttccgcggatttcttttacaaaaggccctgtcagttcacggttcagctgcgcttttaaaaaagagcctttgtctgccgccgcctggagaaagtccggctgaaacacaatgtccaaagttgctttcacagctgccatggcgagcttattaccgccgaaagtcgtaccatgcgtacccggcgtaaaggcgtcggcaagcttctttttgccgatcacggctccgacgggaaaaccgtttccaagccctttcgcagcagtgatgatgtccggagagatgccgaagtgctcatagccgaatgccttgcccgtccggccgattccggtttgaatctcgtctgcgataagcagcgcctgtttgtctttgcaaaatgtctgtaaggcttcgatgaattccggatcggcgggattgactcccccttctccctgcaccgtctcaagcatgacggcggcgatatcatcctcttttgaaagtgtgctgaatgccgacgggtcattaaacggaagatagtgaaagccttggagcatcggtccgaaaccggtcttgattttgtcttgtccggtggcggccatccccgcataggtccgtccgtgaaaggattgatgaaatgttacgatttttgtctttcccgttgctttacgggcaagcttaatggcgccttcattcgcttcggctccgctgttgcagaagaaaacgagatcccccgcgctatgtccggcaagctttgccgcggctttttcctgaagatcattttcaaacagattggaaacgtgccatacgctgccaagctgttctttcaccgcttccgtcaccgcatcatgacaatggccgagattggaaacggcgatgccctgaataaaatcgagatacgtttttccgttttcatcctctgcgattgtccctttcgcttttttaatatcgataggccagcggctgtaggtttgaaataggctgctcatgacacgctctccttttctttaacgatttttgttccttggaagacttgattggtgaaaaacgctccttttccgtttacgatcatcacttcctcgacatcttcactcagtgccgataatgccgagtttaccttcggaatcatcccccctgaaattacgccgtcatcgatgagggcctgaatttcttgcggcgtcaaagtatccagcctgttctctccgtccataattccttcgacatccgtgacaaataaaagtttatcggcgtgtaaggctgaagcgacggccgatgccgcggcgtctgcgttgacgttcagcgtttcgaaatcacttgtcatggaaagcggagcgataacgggaatgatgccttctttcattaatgcgtggatgattgacggatcggttttttgtatttcgccgacttctccgtatttgtcttgattaaggtaagacgcttgaaggagaccgccgtcctttcctgatattcccgcggctttcagcccgtttttcgcgagttcggttacgaaaaatttattgatcgtccctgacaagaccatttccgctgtttccagcaccggtttggtcgttttccgctgtccatcgacaaattccgtttcaatctgcaatgttttcagcattcttgaaatgtccgggcctcctccatgcacgacggcaaggttccagcccgattgcataagctcttttacattttgaaaaaaatcggcggataactcgcggattacactgccgccgcacttaaaaacgatggttttcttcatgccgctcccctttgctatgtgcgatagctcgcattgattttgatataatcataggttaagtcacagccccatgcccggccgctgccggagccttcctgcaggcggactgcaatcgtaatttcatcacctgataagtactccttggcatcagtttccgaaaacggctgaggttcgttgtgtttaaacagacactgaccgccgaggaaaacttccacttgttcggccgttacgcttgccgcactgtgcccgatggcgccgatgatgcgcccccagttggcgtctgtgccgtaaacggcggtcttcacaaggcttgagccgacgatttttttggcgataatattcgcctcaaggttatttttcgcgccttcgactctggcttcaattaatttcgtcgctccttcaccgtctctggcaatatctttggcaaggtcttcgcatacaagctttaacccctttttaaatgccggccagtcagggtgctgctccgtcaggcaatcattccccgcgcagccgttcgccatcacaagcaccatgtcattcgtcgatgtttctccgtcaacggtgatttggttaaatgaaacatccgtaatctctctgagcgcatttttgagcgactgttcttccacggccgcgtccgttgtgacaaagccgagcattgtcgccatgttggggtggatcatgccggagcctttcgccgctccgccgatcgtgatgatgtttccgccgatcaccagttcataacacgtctgtttcgtcactgtatccgtcgtcaaaatggcttcttcaaatgctccggacactgacggcgcttgaccgagctgttcaatgcccgcctgaatttttttcatgtctaaaagctcgccgatcaccccggttgacgaaaccgcaacaagctccggctcaatgccgagctggctcgcgaagccgtcccgcatttcataggcgtcctttaatccttggtctcccgtacaggcgttggcaatcgcgctgttgacgataaccgcctgaagcacggcctctttttttaagctctcttgcgtcactttcaagggcgctgcctgaaaatggctttgcgtatataccgccgcactgactgcaggcgcttcgctgataatcgctccgagatctttttttgaatagcgcagaccgcagtgcacgccctttgcctcaaaccctttcggcgaagatacgccgccttttactttcgtgatttcctcactcagctgaatcatattttcgaatccctctttcgttctatggatagactggcgtcatcgtaagtcccgtttcttcctgccagccattcatgatatttaaattttgaaccgcctgccctgcggcgcctttcatcagattatctatgacagaaacgatggtggcacggtttgttctttcatccacggtgacactgatatcacaaaaattgctgccgtatacctctttcgtcgccggaaattcaccttccggcctgattctgacaaaatatgaatctttgtagaattcggaatacaattctcttacctgtgcagcagacataccagggggagcctccgtatatatcgtcgccataatgccccttgtcatcggcgccaaatgtgcggaaaacgtgatcggacctgtgccgggctgccaagccgctaattgctgttcaatttccggagtatgctgatgctcattaaccttataaattttaaaattatcattcagctcagaataatgagtgcccatggatgcttttcggccggcaccggatacgcctgttttcgcatcaacaatcagaaaagaatcttgtaaaagcttattcttcgccagcggggcgagcccgagcagcacagccgtcggaaaacatcccggattggcaatcagcttagcagtctgaatctcttctttttgcagttcggctaaaccgtaaaccgcgctttgaatcgttcctttcggcgcggccttccgcttataccacttttcatacacggccgggttttgaatccgcagatcgccggatagatcaatgaccgggatgcccgcctccgccagcttgggcgaccactctccggaaacgccgggcggcgcggctataaacatgacatcaatttcgtttcgaatcgtttctatatgaagcggctgaagtgattgtgacgctatattcctcaaatgcggatatgaagcggcatattcttttccttcgtcgctcgatgaatataatatacaatcttctgcataagggtgatggttaagaatcctgacaagttcggcgcctccataaccagtcgcgcctataatacctattttcaacgggttcaccttcttggtttttgtgaaattatttaacattataacatgaataaaaattaattcaattgtatatttaatattttttcattcattttccatcggttttcgctgacaaaaaccccctctcgatcgagggggtttcataagaaaaacaggctgatcggatcagcctgtttttttcagcatcatcagcccgcttataaaaaacagcacggagctggcgtaaaaaataatataaaccgtgaagaaatcagcgagaaacccgccgagaataatggcggcagctgaaaatacggccgtccagaaatgatagctgccgacttttttcccccgctccccgccgtcagtgtaatcggcgatcatgattttctcgccgtgtttttgcatggcgccgaacaggcccaaaagcacctgcaccacataaacctggtgcacgccggtaatgtgcgggagcgtcagaagaagcaccgccatcccccacgaattcgccatcaggaaccagcggggatccagtcttgccgacagccggccgagcagcggatgaatcaatgcgccgctcaggccgaacaagccgtatgatagaccgaattgagtgtagctggaaccgatgtttttaataaataaaatataaaacggaaagatcaggctgccggcaaaaaagacactgctctgagacaggatcagccattttaaatggttgtgtttcatgatttgtacctctgataaaaataattcataaacaagtcatcgggatcatatttgtgttttttctgaaagaacatatcgcttttcggatatgcctcgcgcatctgctctttcgtttgatacagcatatacggcagataatagctgccgcggtggcgcaacgccgtatccgtcatttttctgacaatccgcgctgcactcgcctggctgtcttttgaaaacccttcattgattaaaagaacgagtgaaaacatgtcttcctttgcgtatgacagatcggctttttcatttttttgcacgtagcggatcgtaatatttacgagattgagatcttcatgtgacagcgtcttgcgtaaatcatgaatgtacggtgcaaattcgccgacgggcacgaagtattcttgaagcacgtcggtgttgtccgtgttttcatattccaaaaatttcgattctgaccgcatgacattgttcctggagactttcacgccgttttgactgagaaaataagactgctgggttgaccagaaccaatttcttccccagtcataccggcgggagaggccgagcgcgaatttcgtcagcgccggatgctcatcttctttcagttcattgtgccgctttaattctttctggttgtctgagagtgtgtaatcagtcacatacatatcgtgcaaaaagcctttatcccctgttgcgatccgcgcgagatgcatgcgcacggcggggttgcgctgaacatgctgcgtaaaatattgactgtatgtatcagcgttcatgcgtttcgttttcatttcataaagctcatcatccgtcagctcaatatccgcgtcaaggatgacgccgaacaggccgtagccgccgatgacggctgaaaacaggtcatctttcggagtaacggtgatgactttgccgtccgcctttaaaagatgaaacgatttgaccgtatcaatcagcgaaccgtaccggatatcccggccgtgggcgttggcgctcagtgagcccccgatcgtaaaaatgttttgcgattgcatgacttttaccgcgagcccgtacggattgacatagcgctgaatatcattccacgtcgctcccgcctgcactctgatgatttttttctttcggtcgagaccgagtattttgttgtagcccgtcatgtcgagaacgatgccgtcttcataatacgtctggccgcccattgagtgctgggcgcctgcgattgagatcttcaaatgctttctctttgcttccttaatcgtttcgaccaatgtttctttctcttttcctttgaccgtctgcttaattttcacgggcatgagacggcttacatccgtcattgtccctgcctgccgctccggctctttgtgaaaggcggaaacagcgaacagcgccgtataaacaagaatgctaaggataatgagaagtaattttttcttcatgggttcctccctcgcatgcagccggtctattatatcatgcctccgtccgtttttttcctttttaacccgataccgcaaaaaaccccgaatggcgggaaacttgttttttttagtgacttgcccttctttccgcacgccggtctgcagcgacaaagcagacgcgtccggcagaatcatgtttagtacagttcaaaacggtcatccggaaaacaccaggcataaaaaatacacagaaatccctaaaaatgattttttagtcagtatataatcgatatatatgcagatgtattaccaaagggattgtttaaaacaaagatgttaaatgaggtggggaaaatgaacataaaagggatcaatcatcttcttttttctgtttcagatttggaaaaatctatagaattttatgagaaagtatttcatgcacaacttctggttaaagggcaaaaaacagcatattttgatctgaacgggctttggcttgcacttaacttagaggcggatataccaagaaatgaaatacataaatcctatacgcatacggcctttacaattgacccaaaagattttgatgcaatacttcaaaggttaaaaaatctaaatgtaaatatattaaatgggcgtcctagggataagcaagatcaaaagtcaatttattttactgatcccgatggacataaatttgaattccgcacaggtacactccaagacagactgtcctattacaaaaaagataaacctcatatgaaattttatatataaaggtttgtttgcaatccaaaacaagccctcactgtcgcttatatgcagacaaaagaaaagcacctccaaactttaggatgtacctaaaatccggggtgcattttcttattactgaatccctaatgcgatttttgcgtagcgtgacattttgtctcttgtccacggcggattccagacgatgtggacctccgtctcttttacatccggaatgtcggcgagcgcttttttcacctcgtcgacgatgatcggagcgagcgggcaccccattgatgtcagtgtcatcgtaacgtgcgtcaggccgtcgtcatccatatcaacgtcgtatacaaggccgagattgacgatatcgacgccgagctcagggtcaacaacctgctccaaggcgcccatgatgttttcttttaatgcttcttccacgttccatcactcctttttcctcagtataacgcaaaagcggcttttgttaacacctttgtgctttataaatgcttatcgaaccaggcgacggtttctaaaacggcgtatctcgggactttatgatcagcccgttcgtctttcagaaactgaagatggtcgggccggctgctgtaatgaggtttaatcgtttcataaaagccgcgggtcggtgcatacggaacgactttgtcttgaacgccgtgccagaacagcagcgggcggctgcggagtttttccggttccagactgagatcgaacggtttgagccgcgcaaacagttcatcgacctgttcttttgtgacgtcaatgtcgatgtccttcttttgaatgtggtcaatctgctgctgaaaaaatgccgtatagttcggacttcccatcagactgacgccggctttgacccaatcatacgcagccatcgcgccgaatgtcgtaattccgcccattgacgtccccgcaagaccgatccgcccgtcttcaatcagaccgcgcccttcaaaatcctttttcagcacgtcaagctcctcgatttcatttaagacaatgtcccaaaaatggacggcgagctcttctgctgacagctgttcagcgcgttcaccgtggtaaagagcttccggcagcacggctctgaaacccttttcagcaagcaggtaagcgaaatgaagattatgctccttcgcgcttgtaaaaccgtgaataaagaaaacaaggggagcgggacggtcccgattttcttcttttacaatatgtaaaaacggaatgcctgatacggtttgatgatcaataagaatcacgttgactccctccttaggataaccataatcataagtgtaacatgtagacaataaagatggtaaaaagctacactgtacataagagaaaaacagcaaattatatgacaaaaggagttatttatggagacaaaaccttacctcatcgccttagatctggatggaaccttattaaaagatgataaaaccatttcccctgaaacggcacggacgattcagacgctgaaagaagcgggccatcatgtctgcatctcaaccggccgccctttccgttccagttcgatgtattatgacgagcttgggctgacaacgccgattgtcaattttaacggagcgtttgtccaccacccgaaagacgagtcatggggacgataccacacgtctttatctgtcgatgtggtcagacagcttgccgaacttacagagacctaccaaatacataatgtgctcgctgagatcattgatgatgtgtacttccattatcatgatgagcatttaattgaggcgtttcatatgaatacggcgaatgtcacattcggcgatctgcgcgaaacggtccaagaggatgtgacgtccgtattgattcacgcgaaggaagaggacgtcgcggacatacgcgcgcatttatccgatgtgcacgccgaggtcattgaccacagaagatgggcggctccttggcatgtgattgaaattattaaacacgggatgaataaagcggtcggcctgaagaaaatcagcgactattaccaagtgccgagagaacggatcatcgcgttcggcgacgaagacaacgatcttgaaatgctccgatttgccgggtgcggcgtagcgatgggaaacggcacggatgaagtcaaacaggccgccgatcgcgtcacgggttcaaatgaagcggacggaatcgccgaatttttaaaatcctatttctccctgtgaggttttcccgctcataacacaaagccttccgcccatactaaaacagacgactcatctcgtctaaatatggaagggggacattgcaatgggtaaacgaaacaaatcaaaacggtttattcagcaaggcaaggactctgtcagtcttcatgacgcaagatttccatatcggtctacattagaggaagcacagcatgatgcagcaaaagattcggctgaaaggcaggttgacttttaatgagaaacgaactgttttctcaagccaagtcatttgtccagcaggccgtcatgattgctaacggtttcgaggacggcgaccaggaaaaagctgtctcacgcgccaaaaatgccgtgtcttccgcgtacgccaattcgacggatgcagaacgtcagcagctgcaccaatttcaggatcagctggagaaattgcaataaaaaaaggcgccccgtttagatgagggcgccgcttttttatattacttcaaatgtttttaccgttttcagtctttttccgatctgatcggacttccctaaaaacgtcaccgtcaccgtgtatgttcccggaccgggcacgttcttccacacatctgaaaagtcatacgtttcattcggcattaaggtcacggtctgaaacgcctgggtaaacattttgtcttttgaatagcggtacagttctttgtgatgttggtcatgtacggtcagttcgaatttctgccctgagctgaatgtgaaatcgatcgggctttcgcttttgttttttaaagacatttgaaattcgatctgctgatctgtctgcacaggatttacggctaattccgcttgctgttcattcatctctccggatacctcctcagcgggctccttctgcccggattgactgctgcatccgatcaataaaatgaccggtaataacaggccaaacagccacttcattctatccgctcctatcagtcttttctgaagaaaccaaagatccccgtcgtttgcacgatgtttgtgaaggctttcgggtcgacttctttcacgattttctcaaggtcatacaattcgtaccgcgtgatgacgatgatcatcatttctttctgttcgtttgtgtaagcgccttttgccggcaccgtcgtaatgcctcggaccattttcccgtaaatcgcttctttgatttcatcagctttttttgtaacgatcatggcggtcagtttcatgtggcgcgtgtgaatggcgtcaatcacccttgttgtgacatacagagcgacaagggtatataatgctttctcccatccttgcaataatcctgccgtcaaaatgataatcccgttcaaaatgaagaaatatgtgccgaccggtttatccttccatttggccagcaccatcgacacgatatcaagaccgcctgtcgaagcgccgaatttcagcgttaaaccgatgccgatagctgagatgactcctccgaatacggtattcagaagaatatcgtgtgacagtctcatttccgggagaatccccataaagacggacgtcagcgctacgcttaatatgctgtatacggtgaatgatctgccgactttcagccaccctaacacaccgatgggaatgtttaagaggaacatgagaactcctgtcgaaatataaaagggggcgtattgatcaacgacgcttgacagcagctgggcgacaccggtaaaaccgctggaatatacatttgccggtatcaggaataaattcagtcccgccgcatacagaaacgcgccgatgacgacgattgctaatttttttacttgttctagtaccatggcttgctcctccgctcattttcattattagcttttcccttaaaataaagttttgaacactattttgccaaatttatatgatatagttggcatcactctcaccaaccggaaagaagggaattatgatgacagttcaccttattgctgacagcgcctctgacctgccgaaatcttatattgaagaaaaccggatcgggttcattccgctgcacgtaacacttgacggaaacgaatatgaggacgcggtcaccattcaggcggatcatatctttcaagcgatgcgggaagggaaagttccgaaaacatcccaggcatcaccggatacgataaaaaaagtatttttacaatacgcggaactgggagaaccggcgatatacatcgccttttcctcaggtctttccggcacctatcagacggccgtaatgatcgccaatgaagtaaaagaggaatttcccgattttgatttacggattgtagattccaaatgcgcttcattgggctgcggcctcgcggtgatgcacgcgcaaacactctgtgttaacgggaatacaatacaagaaatcgaaacgtctgtaaagaacttttgcgcacggatgaaacatatatttacggtcgatgacgtcgcctatctcgcacggggcggcagaatttcaaaaacgtccgcttttgtcggggggcttttgaacatcaaaccgattctgcatgtggatgacggcaggctcgtgccgctcgaaaaattgcgcggacagaagaaactgtttaaacggattatagaaatgatgaaggaagaaggcggcgattgggcggatcaaaccgtgggaatcagctatgcagataatgaagagacggcgattgggatgaaggaaatgattgaagaagcgttccatccgaaagaaatcattcttcattcaatcggctctgcgatcggcgcccactccgggccgggcacgctcgcgatttttttcctgaagccataatttcaatgcgggcgggcatcctaacggacagaagggaggctttgccgcatgaaagatgatgacaaaaaaccgttggacaataacgccgtaaaccagaaaaagaaccggcttgccgaaaaaaaccggcaggcgggaaaaaaccagaattccaaaaaaccggaccatctgtaaaagcaaaacagccctcttgtcttaggagaaagagggctgttttttgcgcacggatgtctgttacaaagtaaaccggcggacctgatcgtttaaccgctctgtcaggctcaccagattattgacgctttccgccattttatgaaaagaagacagctgctcaagcgcggaggcagaaatctcttcgcttcctgcagccgtttcctgaacgacggcgctgatgctttcggcatgatgcagcacttgctcaccaagctgtttcgattcgatgatccgtccgtccaattgagtaagctccgccttaatatgggcggctttttgttcaatatgggcgaatgattctgacgttttctccatcagctcctgctgtctgtccgctaaagcgacgccggtcgtgacagctccggtaatagatgtgatgccgtcttcaatttgctttaccatatcgaaaatctgcgcggtcgctttggctgatccgtctgcgagcttccgtatctcctcggcaacgacggcaaatccttttccggcctcgcctgctctggccgcctcgattgcggcgtttaaggacagcagattggtctggcccgcaatgtcggaaacggtctgcgccatcatactgatgcctgccgcatgcttagcggctttgtccgcatcgtccgtcatcgtttttttgagcgccgccagtttatccgagctgcttttcatatagctttgtacatcttctttctgggcgtctgcgagcgtataggaatagccggtgatgctttcttttaacgtattaaggtcggcttttgcttcctggacgtttaacagcgcgtccacttcatcttcatttgaagcctgaatcttcatcatgtttacgatggtaaagccgatgacggcggcgaagcaaatcatcgtaacggctgcgttaacgagcagccttgtccgtaatgtcacttcagatcgcctcctttttcaatcagactgtttttcatatccgtgatctttttcgtcagcccgcctgcgtttttgacaactctgatcttggctaagtccatgccgttttccttcagtccgtaaacgatctcaccgcttttgatctccttgttgtcttttaaatctttcgccaattcatagatgacatggtcgacgtttttcactaaagaagagataacggcgtgctcggcggtgtaatattgatcgctgtcaacaccgatggcgtatacttttcgcgcctccgcttctttcagtgcgccgacacccgtgaagccggccgccgtaaacaggacatcggcttttcttcggatcatgttttgggcgatgcgcttcccgagcttatcatcatcaaacgtaccgctgatttccgacagcacgcggatgttcggtttgactgattccgcgcctttcaggtagcctttcttaaaccgtttaatgacgtcggcatctgaaccgccgataaatccgatcgtgccggttttgctcgtcatagccgcgagcgctccggctaagaagcctccttcatcctctttaaacgtgacggaggtgacattatccaggtctgatacagaatcaatcagcacaaaccgctgcttcggatattttttggcgaccttttctaaatccgcctgcatgctgtaaccgagccccacaacaagatcattgccttcccggacaagctgggtcagtcctttttcgtacgtaccggtgtcttttatttctctgtaatcaaatgtgatgccgagctcgtctcttgctttcatcaaaccttgaaagcctgaatcattaaatgattggtcgccgaggccgttgtctgtcagcatgatgccgattgttttcgttttttcagccgccgccccctcggatttgccggcacatcccgccgtgctgagcgcaagcagcagtacagccgcaaatatcgccatttttctcattgaaactctccttttgtttttttctatagttatatatcggttcggatgtcagaatattttatttcaataaaatatgtatgttcggcaggttgataaacaaatgagggcataggagcttttgagaaaataaaaaacaccggttttggttcaccgatgtttttgcagaaaatttattgtttttcgtatgtccagccgtctttctgatacactttgccgtttttcatcaggtgcccgagcgcccgcttaaaggcggctttgcttaaatgaaaccgttcgcggatatcgtcaggatcgcttttgtctccgtaaggcatcgcgccgtttcttgatctcagataggtcagaatctcctccgcgtcaaccgaaagcgcatcctgctttctcggcagcagggacatgttgacggagccgtcttccttcacctcgatgacacgccccgtcacgcggctgccgagtctcggctcttcttttctttctgaagggtgaataaacgcgcggatgccttcatcggtaatcagaaaagagcctgatgcgatcagtctgtacaccgtgcctgtcaggtctttattcatgacgtcttcctctgcatccgtaaataattcactgatgatatcctcaggcgccggcttggcaaacatgcgtccgcggcttgtcaccttcagcatgcaatacagtctgtcgcctttttgcggccagacggatttgtacggaggcaggtgctccgttgcgacgagcgcgtcttttgacagaccgacgtcgacgaatacgcccatatcctccacagcgtccgtcacttccacccatccgtagtcataaaagctgatgagcggctttttcatcgtcgccgcgagtctttcctgatgatcgacgtaaataaatacgtccacttcatctctgtcttcaatatcctctgtaatttcactgttatgtaaaagaaccgtatcctcgccgtcggttaaaaaataaccgaaatcggtttggtgatctatactaagcgtgagctgctgccctggtctcatgttatcgtccttcctgattcgcccgtatggggctgatgtttttctcattttttccaatatgcataaattcatgctttatgcagttggacatttctctttattctactataatcaactcataagtgaaatgttataggaggttttctcatggcaaaagaaagttcttttgatattgtatccaaagttgaatttcccgaagtgcagaatgcgattcagatgacgctgaaagaaatcggcacgcgctatgactttaaaggatctaaaagcgatgtaactttagaaaaggaagaacttgtcctgatttctgatgacgagtttaaactgaatcagctcaaagatgtgctgagcggcaagctgatcaaacgggacgtgccgacaaaaaacattgaatacggcaaaatcgaaaatgcctcagggggcacggtgcgccagcgcgcgaagcttgtacagggcattgataaagacagcgccaaaaaaatcaacgcggtgattaaaaactccggcttgaaggtaaagtcgcagattcaggacgaccaagtgcgcgtcaccggaaaaaataaagatgatctgcagcagattattgcagccgtccgcggggcagacctgccgattgacgttcaatttattaattttagataaattatgtgattcctattgattattgtctctattttcggtaaatttggagaaagggattttcacagttaagttttggaaacccatgacaattacatgaacgttcttatcaagagaagccgagggactggcccgacgacgcttcagcaaccggtgtaatggtttaacccaaaccatgaccaaggtgctaaatccagcaagctaaaaacagcttggaagataagaagagagacaaatgattacagagtcttcttcttaagaagactttttttatttctcttttttccttgctgaatgtgacgaaggaggcaaacaatgggactattacaagacttaaaagaacggattttaatcggagacggcgcgatgggcactctcctctattcctacggcattgacagatgttttgaggaactgaacgtatcaaagcccgaggaaatcaagcggatacataaggcttacgtggaagccggggcagacatcatccagacaaatacgtacggcgcgaattttattaagctctcaagatacggacttgaggatgaaacgaaaaaaatcaatcaggaggcggtcagaatcgcgcgcgcttcctcagacggcgcttatgtattgggaacgatgggcggcatccgcacatttaacaaaaacgcctacagcctggaggagattaaacgcagctttcgggagcagctttatttattgcttcacgaagagccggacggtctgctcctggaaacatactatgatttagaagaggcgcgcgaagtgctgaagatagcgagaaaagaaacggaacttccgattatgctgaatgtatccatgcacgaacagggcgtgctgcaggacggaacgccgcttcgggaagccctcaggtcaattgccgatctcggcgctgacataacgggaatcaattgccggctcggcccgtaccacatgattgaagcgctcaccgaagtgccgatattccgtgacacttatttatcggtctatccgaacagcagcctcccgtctttagaagaaggccggcttgtttatgatacggacgatgcctatttccgggagagcgccgtacagttccgcactcagggcgcgcgcattatcggcggctgctgcggtacgacgccaaaccatatcagagccatggctgaagcggtccgcggactttcccccgtcactgataaagaagtgaaaatcagacgggaagaagaagtcatctccgtccggaatgaacggaccgagccgggtttaaacgaaatcgccgctcaaaaacggtcaattatcgtagagcttgatccgccgaaaaaattgaattttgacaaatttctgcaagcggcggctgaattaaaagaaaccggcatagaagcgctgacgctcgccgacaattcattggcgacaccgcggatcagcaatgccgcctgcggttcattgctgaaagaacgccttgatatccgttctctcgttcacattacatgcagagaccgcaacatcatcggccttcagtcacatttaatggggctggatacgctcgggcttaccgacattttagccatcacgggcgatccttcaaaaatcggcgactttccgggggctacctccgtctatgatttaacgtcctttgacttgatcaggctgattaaacaattcaacgaaggcatttctttatcagggaaaccgctcggcaagaaaacgaacttttccgtagccggagcatttaatccgaatgtccgccatcttgataaagcggtaaaacggctggagaaaaaaatcgagtgcggagctgactacttcgtgtcccagcctgtctactcggagcagcagctcattgacattcatcatgaaacgaaacatctcaaaacaccggtgtatatcggaattatgccgttaacgagcagccgcaacgcagagtttattcatcatgaaatcccgggcattaagctgtcagacagcatccgggaaaaaatggcgctcgccggcgaagacaagcaaaagcagaaagccgaaggcctcgccatcgccaagtcgcttctcgacacggcgtgcgaactgtttaacggaatttatttaatcaccccgtttctccgttctgatttgacatcagaacttgcagcttatattaagcaaaaggatgaaaagcgggctgatgtatatttgcattgacgcggaagatgccgcctgatacgacaggcggctttttcatggtacgatacagaaaaagaatcaagcaaaggaggattttttcatggttgaagtaaaacccatcaccgcagaagacacatacgcgatcagacacagcgtgctgcgcccccatcagacgattgaggattgtaaatatgatcaggacagcgtcaaaggagcatttcatctcggaggtttttacgacgggacattgatcagcatcgcttctttctacccgcagaaccagcaggctttacaggcggcgcccgcctaccagctgcgcggcatggcaacgcttgaagaataccggacgcaaaaagcgggaagcacgttaatcgcctatgcggaacgaaaactggcagatatgggggcggcgcttgtctggtgcaacgccagatgtcacgtgaagggatattacgaaaagctcggctggaaaagcacgggcagcccctttgacatacccggcatcggcccgcatgtgatcatgtataaagaactcgcctgaaacaggcaaaagcccgtggcatctcttataagggctttgttttgttatctttcggcgtgccggatgacgttcaaacggaatgaagcttttataagcgccgctattgacgcgatcccgctttgatattaacctttgttcagtaaacaacacgcaattcggcaagggtgggcaggggcgaaaacgatatctgccaattgccgatttcagctattatgtttagaaaagggagtatgagatgaatacgatccaaaaaccgaaaatcccgaaagaattgccggtgctttctttcactgaagcgcttcaggatgaggagctcaaagaagtcatcattgaaaacggcatcgtaaacggcaaactggacggcctgcgcgccgaaaaagtcattttcagaaacaccgtttttacggatgtctctttcagacatatggaatgtacggatgtcctgtttgacaaatgcgatgtctcaaacgctgatttcagcggaagcatcatccatagaacggcgtttcagcattcaaaacttctcggcttgaatctggcggattccgccatgcgtcatgtacggtttgaagactgcctcgcaaattacagctccttcagctattccaatatgaagcatgtccgttttgactcgtgcggcctttcagaaagtgagtggaatgatgctgttcttgaatacacagatcttgacgtctgtgatttgaacggcgcaaacttcatcggcacgtctctttttaatatggatatcagcacgtgcacatttgatcatctgcacgtctcgcttgataagctgaaaggatgccgcatctctccgtctcatgccgttacattcgcagaagcgctcggcgccatcgtgacgtgattttttattaaacgaaaccgcggatacaggcggccggctccccggcatcctgaatcaatgctcggcattggtgatgtggggtgctgctttttattttgcggcgcttttgtttcgataaaaggaattcggccaggtcatgttgaatgtaccggaaggaagagggggaattggaatgtcagacattttaaagctgtatcactaccatagatgggccaatgagcaagttattcagcatctgaagaccctgcccgcggcaagcttacagcaggaactggatagtgtttttccgactttgaacgccgtgcttgtgcatatatgccgggctgattacacttggcttcacgtgctttacagagaaacttacgaacaaatcgtctcgcagtttgatcaatttgaaaagcttgacggagattttgaggcgattgaacatagaatgactgaactggacaaagaatacagcgaatttttaagagaatcggagaacatggaaggcccgatctccatttctcatccgcgcatgggaacgcttcggacgacatatgccgatgtgatccggcatattgtgaatcacggcacataccatcgcggcaatataagcgcgatgcttcaccaaatgggctataaaggcgtgccgactgactacatttttttctcatatgaattataaaaaagcaaaggcatgccgggcctttgcttttttacttcgaatctatcataatccggcatagccgggggcgcccggggtaagctttacaggccttccggttttaaaagattccgtcgcggcgatcccgatttttaagttaatcgcggcatcgatgtctgtcacaatcggcgtttccccttttttcacacattcggcaaagtgctcaagctccagacggtaagcgtctttaaagcgggcttgaaaatccggaataatttcgtagctgctgcctgactccgttaaaatggtgacatggcttttccgcagcgtgccgactaaaatgcttccctccgtcccgataatttccgcgcggatgtcatggccgtacggagaatttcggcttgcctccacatcgccggccgcgcccgaatcaaactcaagatatgttaatgcctgatcgacatcgccgcactcctccatgaacgggtgctttaaaatcctcccgtgcccgctgacagacgtaacctcggcattcatgagatatctcgcgatgtcgtaatcatgaatcgagcagtcaatgaaaagccctccgctatgtttgataaattccgcgggcggtgcgccttgatctcttgtaaatcctttataataaatgggtctgccgatttccccggcgtcgattcttcttttcgcgtcggcgtatgccggatcaaaccgcctcataaaaccgacctggcagatgacgtccgtttcttcgatttttttcatgacttttatcgattcctcaagactcagggtgagcggcttttcaacaaagatgtgcttgccgttttcagccgccttcatgatcatttccgcatgtgtgcttgtcggcgtgacaatgatgacggcgtcaatcgtgagatcttccagcagttcatacggattctccgtccatttggcgattcctaattctttcgcacacgcttccgccttccccttcatcgggtcacagacggccgcaagctcggctccccgcacttcgccggctaaatgcttcgcatgaaaataccctaatcgtcctaatcccagcaccgcacacctgacttgatctgtcatctatcaccgctccttttttcttgaggccgcatgccgtaatggcgcaagcggtttctcttattaaacagaaatcattattttgaaagcgctttatttacaactcaagctgtttgctttctttgcttgcaatccgcagtatttgcgcaagcgctttctcaaaagctgttttaattttacaatgcttttcgctcgtttgacaatgtttttcacagaaaaaaacgcgccttatcgctgagggcgcgtttttaccggtgccgtagaatgcctgatgacgagttccggagataaaatgattttgctttttgtttttttcttcccttgaatctcatcaatgagaagttcaacgacacgccgccccatttcgcggatcggctgagaaatcgtcgtgagcggcggtgccgtcatttcagcgagaatggtattgtcaaagccgatgacggacaagtcttccggcacccgaatgccccgggagcgcgccgcctgtatcgccgcacatgacaagacatcattaaaggcgaaaacggcggtcggaaggtctctgtcaaacagctcgcccgctgcctgttttccgctttccagcgaatattccgtcggtatgatcagcgattcatctagtgtcatccccgcttcccgcagcgctttttgaaaacctttgattctgtctctttcacccgtggtcgaaccgtttccgacgatacaggcgattctttcatggcctaaagatatgagatgctcagccgccgtatagccgccgagaaagtcatcgataatgacgacgtccatcggcgcgagcggtttatcctgcgtaatcatcgcaagcgggatgcccgatttcacaatatcatcaagcgccgtgacgctgtcatcatgatcaagtcccgtcgcgaatataatgccgtccgcctgcttctgccgcagcatcgaaaaatacttcgtttctttttcaggctgataatcggtgctgcagataatgatatgaaacccaagtacaccggcgctgtcttcaatgcttttcgccagttccccgaaaaacgggtttgaaatgtccggggtgatcaggccgatcatattcgtctttttgcccgtcaaagcggatgcgtgaacattcggatgatagtccatctcctccatgacacggagcaccatccggcgggttttgtcactgatcctccccgtattgttgatgacccgcgagacggtcgagatggagacgcccgctttttcggccacgtcgtaaattgtcattttcatgcttaccgatccctcttctgttctctggtattaggtcagtccgttttccggcttacgaatttgcggtattcaagcggcgaaatgccttcaatctgtttaaacagtttggaaaaataggttgggtcctccatgccgatggcgtccgcgatcgcccccattttgtcattggttgcggacaaaagacgtttcgcctccgtcattctgactttgttcgtatactggccgggcgtgacgccgagcacctgctgcatgcagcgggtcacgtagtcttggttgtaatgaagtgccgaagagagcgctttgatggttgttttctcctgatagtgctcctgcaggtaccgggcggcctcccatgcgactctttcctttgcggacgggatttggaacgcttctttctgaagatggagcagcagctcttcaaacagaatctgctttctgagcggcaggtcggagttctcggcgctttcatctgtcagcacactgaattgcccggccataaactgcgggcgtctcaccttccctttttgcggcagggacaagcggtagcgggacggctcttcaaagctccctttttttcgcctcagctccgaccagttgttcccggtggtttccgtcacctcataatccgctccttcaaaatgaagccacgaataggatgtcgtttcttcactgccttttgttccgtaatgttcaagcccgggagaaagcagaatatattctcccgcttcaacggaaaaggcgttttcgtcttctgtaatgtagaggacgccttctttcacatacagcagatcaaacaccgggaagacccgtctcacatgggtttcgccttttttgaacactccttctcccgcagcgataaagaccgggaacggagggactgtgaactcgagaaaggacatatttccggccctcctttttaagtcggatttttgcaagaagtttcgtttctctccctttttattataagaaaatggaggtacacttttaaacgttgattttttcaggaaaggggttaaaagaaatgaaacaagcgattttaaaacgggctgcattcaaacaatcctctgatcacaaactctcattatacgcgctgacttggccgatatttattgaggtttcattatatatgtttatgggaaacgccgacactcttatgcttagccaatactctgacaacagtgtggcggccgtgggtgtcagcaatcagattttaaatttaattatcgtgatgttcagctttatcgcaacgggtacgacaattgtgatttcacagtttttaggatctaaacagaaaaaagaggcgcaggaagtggcttatgtatcaataggagcgaactttgtcatcagtctcgccatcagcgccgccatattttttgcggccgttccgctgcttcatgtgatgggtctttccaatgaattgatgccggatgccaaagtctttttgcaggtggtcggcgggctgtccttcattcaggctttgattatgacgttcagcgccattttaaaaagctacggtcatacgaaggatacgatgttcgttacgatcgggatgaatattttaaatattggcggaaactttcttgtcattttcgggccgctcggccttccggtgttaggcgtcgccggtgttgcgatgtcaacgtcctttgcgcggatcatcgggctcatcgcgatgattgtgatcgtcaaaaaacgcatcggactcggtctgacatggcaaaagatttttcacgtccataaagagcacttgcggaaactcctgaaaatcgggattccgtctgccggcgaacagctgtcttataacatttcacaaatggttgtcacttattttatcgccattatgggcgctcaggcgcttacaacaaaggtttatacacaaaacatcaccatgtttatcctgctgttcggaacggcgatcagccagggcacacagattttgatcggcagatatatcggcgccaaacggtttgacgacgcttatgaccgctgcatgaaaagtctgtactgggcgcttggcattgccgctttgacatccgtgatcatgaccttgttttcaaagcagctgatcggaattttcacaagcagccctgacattattgcgacggcgagcatgctgatcgccatgacgatcattcttgagcccggccgttcatttaatgtcattatcatcaactcgctgcgggctgccggagatgcaaaattccccgtctacatggcgatgatttccatgtggggtatcggactgcctctcgcttatctgttcggcatccatttcggattggggcttatgggcatctggatttcatttatcgcggatgaatgggtcagaggcattcttatgtacagaagatggcggtcgcggatttggattcaaaaagggattgcataaacgccccgagcttcgttaagaagccgggcgtttttttatgcctgcgaaagccgttttctcatgtcaccgagctctgaccggtaatgtgccagcaaaccggtaacggcgggtcttgagtataacggaaacagctccagctcttcagacgcctcctcgaaatacgcctcggcctcgaatgcgatgtactcccatacattcataaaagctttgttgacggtatggctctccagctcttcttccgtatagccgaattgcatcatcacctggcgcgggagacgctttttcgaccactcatccgtatggaccctcagaagcacccgggtcagctgaatggctgctcctaatgaaacggctgcatggcggagtttctcttggttccggcgcgcgcaaaccggcagcagaagcaggccgagggctccgcctgtttggcccgcgtacatcagcaggtcatcaaactcttgatacgttactttttctctgtcagagatgtggccggcgataaactcacgcaacggctcttcttcaagtgcaaattgctgccgcacatcagtgagcgcctcccacaaaaagccgtcggcgcgtgccccgttcagaaagtcttgtgccgcctgttcaaatcccccaagttcctgcatatcaagccgatcagcttcgtgaaacaaagcaagcaccgcccatgcggcccgcctgttttttggcggcagggatgagaaagtccgtttatataaaggaaagtgcacctcggcaagatgggcgcatgtttcgtattcggtcatggtatcactcctctgttttttagtgtaccatatgtttcacaataaaaagaccgatatccttcagcggaaaccggtcgcggcactgttattcttctatatcgatacggtacgcctcaaaccatgtatggatctgggcaagatgggcgatcagctgcgggcctttcatcagctggccgaaccacggcacctgaaaagatgaaccttctgtctccagcagcatttccagcttctttctgtcaagcagggtgtgaagcacggaatctttctgttgtaaaatcgttttcagccattctgtgaccccctgcgtgtatttcgggtgatgcgttttcggataagggctttttttgcggtacaaaatatcttcaggaagcagtccttcaagcgctttccgcaaaatgcctttttcccggctgccatgcattttcatttcccaaggaatattccaaacgtattccacaagtctgtggtcggcgaacggcacccgtacttcaagacttgcgcccatgctcatgcggtctttgcggtcgagcagattggtcataaaccaaagcatatttaagtagaacagctgccgtctcgctttatctgttcccgtctcaccgtctaacagcggcgtttccgcaatggtttcttcatatctcgcattcacgtattctctaagattcagccgtttttgccacttttcatccaagagcgtgaccctctcctcagtcgacctcatccaaggaaatccgtcttcttctgccgcggtgtgaaaccacggatatccgccgaaaatttcgtccgcgcattctccggaaaggctcacgacaaaatcttttttaatttcccggcagaaccataatagcgatgaatcaacatcagccatgcccggcaggtctctgacgagaacggattcctccagatgttcaaccagctgatcctgcgtaatcacgcacttatgatgctgtgtgccgaatgcatttgtcattttatcgatccacgggccgtcatcattcggctgaaaggcgctcgctttaaaaaatttgctgttctcctcataatcaattgaataagtatgaaggggatctcttccttgtttctcaaaatgagcggcggctatcgcggttatcgcgctcgaatcaagcccccctgataaaaacgtgcaaaccggcacgtcagatacgagctggcgtgtcactgcatcctgaaataagtaccgaatgtgagcggcggtttcatcgaagctgtctgtatgcttttcgctctttacattccaataacgccatatggacaaaccgtcctttgagaaagtgaacgcatgggcgggacgcacctcgtgaattcctttaaacaccccgcagcccggagttctggacggcccgagtccgaatacttccgcaagtccgccgctgtctgtgcgggctttcacatcaggatgagcaagaatggctttcaattccgacccaaacagaaaggaagagccgtgttctttataaaaaaacggcttgacgccgagccggtctcttgccccgaagagccgctttcgcttttcatcccagatggcaaaagcgaaaataccgttcaagcggtccacgcactcctcccgccactcaatatagctgtgcagcagcacttctgtatcagaggtcctctcaaaacggtggcccctcgcctgaagctccttccgcaattcctccgtgttatacagctcgccattataaatgatggtgtacgtttcctcttgatgcgtgcaggccatcggctggcggccgccttcaatgtcaacgaccgaaagtcttttatgtccgaataaaacatggggctctccccagacgtttgaatcatcaggccctcgttttgaaagagtgtctatcatattgttcataatatgtttctcttggacgagctgcttttgaaaatcgacccaacccgcaattccacacatgtgatatcagctccaatcccgtttctgtcggtttcaaattcgtttctatcagcactttacccagtttatgcaaagaaacgcagatagttgatttgtcccactaagagttgtatgagacaagcccgatttggaaagaacggaagagaagaaacaaacaaaggagacgggcacggttatgaaacgaaaacagcttttctcagaaaaaaacaaatgggggcgcggcacactgatgatagaggacggcatctgcctcgtcgaaaacgatgaaggcgatatcctgcttgcagacagtctcggaaacgcagacgtattgatgaaacgcgacggcagatggcagccggcacggatttgcggcggttcggccgaaatcggcgcagacaccatccccctgctcggcggggaagaaatccgttatgaaaaggcggtcaaacggccgctgttaaccttgctcgattcgctggacgatgaaacgtttctgctgtttctcagccatctgcacgggttcggcctgtctgtatatgattgcgtattttcctataatcaggcgctgttttccggtgaaggcgtttcgttttatcacttctcggcggatgacgcacaatgcgccctgcagcatcaccgcggcagctcgggtaaacacgacagatttgaatggacggcatctgacgggcggcgctccattatgtattcagcggcaagacaagacggcaccgcgtaacaaacaggcggcaccttttaaataggtgccgcctgatgtattcagctttgtttttcacgctgattgacggccggcgtttgcttttacccttcacagccgtagcttttgcggcaacaagagtgattgacgcttttggcatcctggacatctctttcgcctcatcaacacggcatttctcattcagcggcccagttgcgcaactaaaaaaaacccggatgcatccgggtttttcaagcgattgattaaaatacgtgaaaaccgatcggcaagtgaaggcccagcagcaccgtcaggacgagcacgataataaaaccgatccacagtccgccggttgatttgccttttttcttgcggatgacgagcatttccatcagtccgatggtaatgatgccgagcagcatttttcctgcgtactctccgttccaattcgcaaaacggacaaaaagctcagctccggtcagaataataataatgtagaataagcgcagaatcatatgcgtaatttttgcgcccttcgcttttccggcaccgtacagcccgtagctgacaaacaccaggataagcgcaacgacccatgaagtaatatgccaatgtgtcattatgttcaattccccctatcagatcaatctgcctcatttatggtaccacaacaagccgctcggagcattatcaatcgtgcgaaagacacacaattatccgatttggttcgacagcgtgccgatcggttcaattgtaatgtcaatgcggtcccccggctttaaaaatttcggcggcttaaacccttttccgacaccggacggcgttcccgtcgctataatgtcaccggcttcaagcgtcatcccttttgacagcgtctcaattaattcagctatcggaaaaatcatgtcacccgttgatcctgattggcgcagttctccgttcacccgcgtttcaactttcaggctttgcggatcactgacggccgacttatgtacaatgaccgggcccatcggacatgtcgtatcgaggcttttgccgataaaaaactgtttatgttttttctgcagatcgcgcgctgtgatatcatttacaattgtatagccgaatatatgatcaagcgcatgttctttggagatgtgcgatccgctttttgatatgattaccgcaagctccccttcataatcaagctgctccgttacatccaagtggctgttcactgtttctccgtggcctgtaacggcagccggggctttcgtaaaaaccatgggatgctccggtatatccgcctcactccccatttcaacggcatgatcacgataatttttcccgatgcagatcacgttctttgaaggtctcggaataggcgcgcaaagctttacgtcagacagcgcatacataaatgaacccgactcgtcattcggttttttcgcccattccgcaagctgtccggcatgcgcgacgaacttatctcctttttgaatgcactcgatcagcgaacccggaatcgtctcaagttcaaacaattttttttcagccttttgcagatctaagattttgtcatcatcaataatcagaccgacaaattttcggctgttcagttcccctgttgcaaatttcatgttaatcccccatcatttttaaatggcattcctttatgtattcttcctccgggcgggaaatccctcttttaaacaggctgaaaataagtgtaaaagagtatcaaaaattgtcacttttttagtcatattgacgaaataaaaccttcttggccaaaatgggttatactattatcatcctatgttttccaaaataatcgagaattggagatcacacgatgaacaaaattgaagaaaaaagattaactttattcgagacagcgcaaaaattcggaatcaatgcgacggagaccatcaggtgcagccaggagctggacagccttttaaacgggtgccggggcgggctcatccaacaaacgaaagacagcgggccgaacccggccgcacagattcagcacggccgcgaaagaaaagaggctttctcataaacgtgatatgtatataaatctgtatcatttatgtataagacccggcatctgtaaagcgccggtgttttttacgtctaaagttttttccgctcacaaaaatgtgcatttgtcataagctattttaggcaggcagcccagataagctcctggagtgcagtcatgaaaatcttcacgaaaaggatgtgctcgtatgcccgcaattgtcggagcgtttaaaattaatgccgtcggtacgagcggagtcgttcatataggcgactgcatcaccatttctccaaaagcagaggttaagacatttgccggagcgggcagcttcaataccggagacaatctcacactgacgaattacaggaattcaacgaatgtgtacgataatgatgtaatcgatcagccgatggcaggaaacgcataaaggaggcgccgtatgaatttttacgtcaatcagtcgatccatatcaattacatgcgtgtagaatctgtcagcaattcctccatactgcaaatcggaagcgccggttcaattaaatctctttccaatctgtacaacacagggagttatgttgagccggcgccgcctgtcaccgcggggcagcaggctgtaacaacagggggaggtcccggcacctcatcatttgtaccgctccagccgccaagccggtagttttaatgaaggaaacgagacgcgaggtgaatgtcatgtatgatcaatccgtttcatcctacctgcagaatttaaattctttcgtccagcagcaggcgcagcagattcaggagctcgaacggcagctgaaagaattccaaaatgaaatttcaacgctgaagcagcagccttctacaagaatcgatcggctcgagtataaatttgatcagctgaaaattgaacggctggaaggaacgctgaatatcggattgaatccgactgatccgaatgccgtgcaaaacttcgaagtcggccagacatctccgcaggtcggaatgatgcagcaggaacaggcgggccagcaaatgcagcaaatccgtcaaaacgtcgatatgtacctgaatgaagaaatccccgcgcttttagagcagctcgaaactcagtatgagagcaggctggacgaaacgaacaaatatcatattattgaagatatcagaaagcagatggacagccggattcagtattatctgtcccatgtcccgaaagaagaaaatacggcgcccgcgcaatatgccgagcagattgccgaacatgtgaagcgtgatattgtcagggccgtcgagcactttattaaacacatacctggtgaaatgaaaggtgatgatccgtcatgatttttacagtgattaaccggaatattgaagtcggcgacatccggtctactggtgtatccagttcttccttattattaatcggcgacaccgattccgtctatctgtcttccatctttgacacgcctccggaatctcttattatcgggccttatgtgccgctggcgccggaataatgttaaagcgcatttcacgcctccggaacgccaaaatcaattcagtcgggattgcgagtgtctttcaagcaggcgatacgaatgaaatcaatatgcggatcaaagtattggccgatcagcgcagtcttgctgtatacagagatgatgaaggctcatttaacaaaaaagaataccagatctttcggcagccggccgtcatgccgttaccggaaacgggagtccaaagcgcattctgccatgaaaatccttcaattcgggtaaggaatgtgaaagttcaaggggtatcgtcagcgtccgtggttcaaatcggatcgacgtcggtcgttctgggagattcgcggctgaaacatattaggcagatcttcacgccaagctcacaatcacagcagccctgacatataatgacggtgagacttctataaagggtgtcgtttatgccagcaattaccggacctatagctatcaattccatatcgggcggagtcgtaaactttggtgattccttttacctttctccaaaaagctcttctaaatctgcgctcggttcgggagcaggcaataccggagatttcctgttattaaacaacgttgtcaatgcgacaaactatatagaccccgatgtcagcgatcaaaatgtggtcggaaacgcctaaaaagcagccgctctttcagaagagggctgcttttggttcagcgttattttcgttcatttgctttttttgtttttacaagcttttccggcggctgttttctgatccatttcacaaaccgcgcgagtttcgggtcacgccgcagctcttctattcccgcgagccttgccgcaagctcctgattcgtatagagcgcgtgaacctgtttatgacaagggatgcagagcattgcggtcggaaggaatgtcccgccttcttccttaggcgttaagtggtgctccgtcagccgcacataatggcggccgcataattcacatgtaccctcggcagaatcggccataattccttctcctttctacatgatctccaatgtgacccgggtgcctttcccgcccggttcggacggatgaacgattaattttttcggcagacgcgctctcagctcctgcacatggctgatcactccgacggataagttgtccgattgcagcttttcgagcgctgtgacaacggtgtctaagagcccttggtcaagagtcccgaatccttcatctaagaaaaagaattgcagcgggtattgcccccgcagctgaatctgggcggacaaggccagcgcaagcgacagcgatgtcagaaacgtctccccgccggaaaggcttgatacgggccgtttgacgcctccgttcgcgtcatcacgcatgacgaaaccgccttctgaatcgactaatatggcataccgctgccttgtcagcgctccgagacgggcagaggcgtcccgagccacgctttccagctgttcttccgctaaaaattcgacgaatgtattgcctttacatacagactggagcttatcaagcctgtcaatctgtgtctgccagtttttcagttcggcttcaatctctttaaagcgcttatgctgtttttgcataaccgcgaaggcttttgcctgtgctcctttttcctccatggcggcgcctgactcagcctctgcctgcttcagcagagaaacggatgctgtccattcttcctccgatatccggcgctcggctaatttatcagtaacacggctgatatttgccgatagctgttttgaggtgtccagaaactcatcaatttcttttttcatttcctctgcacgcccttgcggaagcagactttttttaacttggtccggttcggtaaacccggtgtcttttgacctcacgcgccagtcgttttgcgctttctcaagagaggcctcagcatccctgagtgacatgagactccctgattcccggccttttgcgtcattcagcgattgctgcgcctgcttcagcgcatcgaatagggactgttcttttgattttaacagctgtaattcctgccgcaccgcttcaagctttgcggaaattgatgtttcttcagctgctgttccgagctcttgttcatatccgtcaatcacctgctgcaggcgctcagacgcatagtgaagctcgagccgttcccgttcaagccgatgcttcatctcctgcaggcgttctttctcctcttcatgttccttgaggaatgcgatgcttgtttcaatgcgcttctcacattcttctgcctgcctgtccttctcatctatcgaagcctgccaggcgtcaatccggtttggcggaatatgaccgcagacttcgttgtactgattcaatcggctttctgacagcgattcaagctcttctaatgaatgtctgagacggtcggcttctttttcctcgtagcggattcgttcggcaagctgctcagcttgttttaccgtctgctgatgcgcgctgatcagtcttgcgaccttctcttttaccgacagcatatcctgtttcatttgtttccattccaagcggacggcgctgaacgcttcatcaagcgggcgtccgctgatggaagaagcggcttccagctccggaacccgggcgctttgcagaaacggacattcttcggtaaaacgccccgactgttcttctaatgcaaccttggctgtcagcacttcctgagaaagagccgccgcctcagaaagcagtgcttccacctgctgcaaatgttcctgcacagcggtatcaggcgagaatgtttcatgagcggaacgcgggcggtcatgctgcgtcgagccgcatacaggacaaggctttccttcgatcagtttttccgataattcttttgttaatgcagccgttctcgcttcctctgagcgcctgcggagatcggcttgcgttttttcagcccgttcggctgcggctttcagtgaacgttccgtttcacagaccatatggtaaacggtttgcagcgtttgataagcgcgcgtaatgtcttcctcttccgttttcgctttcgctgtgagcgactcgctttctccgttgagcttctccacgtttttcagctgcgttgtcagattggcccgctctttcgtgatttgttcctgtgtctgctgaaagcctgccgccagctgtgctgcggtctggcattttttccgttcatctgcggtcacttgaactgctttcagctcttctttcagctcattctgcctgttttggccgcgggtcaggcggtctttcactgcggccagctgtttcgaggcggcttcgtattcttcctcttttttgctgtgctccgcatttgttttttccgcttcttttttcgcttcaagcagtttttgttcaatggctgaaagtctttgatacagctcttcttccttgacaagtttcggctcctgttcggccttatgggcgcgccatgcttcataggcttcattttgccgggtaaatgaaacggtttccgcctctgatttccgtttggccagttcgtgttcctgttcggctcgctgcttccggcggacggcttcggtgcagcggtctgcgtacggctcaagggcgagagctgtttccgcctctttaagacgctcagtcaaatccgtgatgtacgggcgtctttcctcaagctttttctcccggcgctcatattcatctctttctgtctgcaagttccaaatttcctggtgattttcaaaacgctcttttgcccggacccgtttcttctcagctgcttcaagccgttcgttcgcttcgtgaaactgctgttcagcctgcttcagcgcatcttctcctgcgtctccgaggccggattgttcggccagcatttcattttttttcgctgccgcttcctgcgcccgccgccgcaattttttgacaagcctgtccccgtactgttccagattaaacagacgctggagcatatgtcttctttccgcgcctttaagcgacagaaactcggcaaactttccttgcggcagcacgacggctcttgtaaagtcgtcaatggtcaggccaagaagctcctctacctttttgttcacttcattcgctttatcggccagcaccgtttgttcgtctttgatttcaatcagccggcagagggcggtttttactttcgtttcatccgttctcttaaaaacgcgctcgaccttgtaggaaacccggtggccggattgaagcgcgaatgtaaatgagacggcaagctgatcttcggcatgattcagaatgccgtgcgtattatttgcggcgcgctccacttttccgtataaagcgagtgtcatggcatcaaggatcgacgattttccgcttccggtcggcccgaaaatcccgaacaccccggctcctgacagtccggcaaaatcaatggtctgttcctccctgaagctgtggagcccttttatcgttaacagaatcggcttcatgtcgcatcctcctcatcatctgctgacgcaagctctaaaaacagcttgaccatctcctcatccggcacgccgccgcccgtttgtttttcataaaacttcttaaatcgatcctcaattgatgtgtgtttcacttcaatccggtcattttcggtctctttttcttcaaaaaccggcctgatatggataaagccgggatgcgcctttctcagccgatgaatttcctcgagagaaagctgatccgtcaaatggatatcaagatcgatccaggcattccggtcacgcccttcatcaagccagccgtgaacctcgctcagcccctgcgctttccatttgacgagcggtttaccggaagacaggaaaatctcttcccacttcgcttctccgccgggcttcgcttctaccactgtcaccgatttggcataaccggcttccgaaaagctgtatgcgagcggagagcctgaataacgggcagccgtcttggcgcgcttgatcgtttgcggacggtggagatggccgagagccacgtaagccgcatcagccggcaggctgtcagcggcgaccgtgtaggcgcccccgacttcaatcggacgctctgaatcggtctgatttccccccgcgacataaatgtggctcgccgcgattttcacggcatcgttccggcacagtccgcacatgtgagcaaacgcctctctgattttcacatcgtaatgatcgcgaagaagcttttcctcaaacgtatcagaaagcacttcgtttaatctcgcctctgacggatatgccagcgcggctacggctaacagctcgtccgccgacggcacctcaatatggacgggttctgtccgcggatagccgattaaatgaatgccgcgctcatttgttaacggagaagccgccgccagcctgtcgggattgtcatggtttccggcaatgacgacaaccgggcgttttccgccgtcagaaagcgcggaaagactttcgtaatacaattgttcagcgagcgcaggcgggttgaccgtatcgaatacatcccccgccataatgaccgcatcaatgttttcttccttgacaatggtattcagctcttccagtacttcggcctgctcgctcagccggcttctgccttccagcgttttgccgaggtgccagtcagctgtatgtaaaatgcgcataccgcattcacctcactttttgatagaaaaaaagatccgctccaaaaaggagcttcggatctcgttacagtgtaagaacgtgacctccatcgaagaaatagagcgcacgccctttcactttcgtttttgtaatttgttcaaccgcttttgtatacaattcgatttgtgtttcatatcttttttgcagaatcggagccgcgccttcaaatccattccggaatttcccctctatccgatctgttttatagtccagcaaatagagaccgtccgcagtttcgtagaggcagtcaataatcccttgcacgagcagcggttcaccggccgtttcggcatccttgtacacctcgccggccggaagcgccatactgaacggcacttcccggtcaatccgcagcgccccgagaaggtctttaccgatttcagttccgaaaaaccggacaatttcttctatatcaatggcttcctgctgctcttctgtcagcagctctttttcgtaaagcatccggaccgtccgctctgcttcttcggcagtcggaatgtgcgtcagcggtatgtgctgcatcaccgtatgcatcgccgtccctttttcggcggctgtcagcccttttttcatcataaaaccgggacgcctgtataaaagcgtgtctcctgacggtttgatgagagagcggccgctgtattcatcctcgtactcttgctttctcttcagctcagaaactgactgcttcgttctgatagccgtcagctctcggtacggatattcccatttaagcagacggcgcgcctgatcatcaaatgaaaacgaaccaggaatcggctcgccctgctgtatcgccttgagacgtttgctcttttcttcagcacgttcttttggattctcttccagcaattcactttgctgcagcatccggatgtgaaaacgcgacgggtcgcgcgcgatatcctcagacgaagaaagtcccggcgtcctgtgcgcctccatgtcacggtggcggatgagcgccggcccgataaagtccaaataagatgacgcctgatagcggtcgaattcagaaagaagccaatcagcccggtctgcttgggcctgccatttggccagctgtttttcccggtttttgcaggaaccgacgagaaacagcttttccttcgctctggtcagcgccacatacaatacgcgcaattcttcggataagagctctctgcgcatctttttcttcatcgccacaagcggaagagtcggatagctgattctgagttccggatgaatatacttcgtgccgaaaccgagctctttatcaagcaggtatgatttgttgagatccatcatattaaaacttctgccgagtccagcggtgaaaacgacgggaaattcaagtcctttgctgctgtggatcgtcatcagccgaacgacatcctcctgctcgctgagcgcacgggcggtccccagatcatcgccgcgctcctgcatccgttcaataaaccgcaaaaagcggaataacccgcggaacgccgtcgcttcgtacgagcgcgcccggtcatacaagacgcgcagattggcctggcgctgctttccgccgggcatgccgcctgcatagtcaaaatatccggtatcgcggtatacttcccaaatcagctcagacaccgaatgattcgtcgaaaatgaccgccacttttgcagactgtcataaaaggttctcagtttttgatacagttcatcatgcctgtcaccgttcgctatatatgctttcagcgcttcataaaacggcgcttttttcttttcaaggcgtatcagcgcaagttcattttcgtcacagccgacgatgggcgagcgcagcacggaagcaagcggaatatcctgatacggattatcaatcaccttcaagactgaaagcgccgcagccacctccacggcttcaaagtaacccgacgtcaaattggcgtacaccggaatgccctggtttttcagctcttccattaattgcggcgcccacggcatggagcgcagcaaaatcacgatatcccggtactggatattccggtgtgtttttgttttcccgtcatagaccttaaacggagacgagacaagctttcggatctccccggctatcgctttcgcttcccaatgcacggtttcaaagtcttcggcatcctcggagctgtctgcgtcatcagcgctgtcaatcagcagcagttccgtttttgccgcgtcattcggcggatacgatgcgccgagcttcaatgccgcctgttcatcgtagtccacttcgccgatttttccgcccatcagctgcttaaacaagaaattcgtactgtccaaaatatcggaacggctgcggaaattttggttcaggtcaattttctgccccgcgccttccccgctttctgtaaaccttttatatttcccgagaaacagcagcggctcagcaagtctgaaacggtagatcgattgtttaacgtcgcctaccataaacagatttcccgcctcttcatccccgcttttcacaagctgcaggatagactcctgcacaagattggtatcttgatattcatcaaccagaacttcatgaaactggtcttgataataaacggccgcttcgctcggcacccgccggccttcttcatcaaccgcagttagaatcgccaggcagtaatgttccaaatctgagaaatcaataattgatttttcttgtttcgccgcttcaaatcgttttccgtacgatatcacgagctgaacgagcgtttcgatgacaggcttcatatctgttaaactcttcaagtgatcttgcggacttcttgtaaagtaatcggtctttaacttttcgatcagtttcttcgcgccgtttcgcaaatcggtcgcttcgtccaaaagcgctttgtcaaattcatcaccctttaccggcttcgcccgcttaaatgagactgcggggacccgttcatacagcgcatcgaagtcatgccggcagctgatcagctcttctatctgctgaaggtcatccagaaaattaccagcgcgcggggccggcccgccgggcgcttttgtcagttcaagcgccttctcaagcttttgttttgccccgaagagcgccatttccgcatcttctctcacatactggtaaaacggaagctcttccattttgctttcttccgtcacgtcatacaagcggacaaagctctgcagccacgcttccgggtcaggatgcgaccgggaatactcgtacacccgtttgacaaggtcttgaagatccagatcatgcctgtctgtcgtatatctgtctgcaagctcaaaaaacgcctgattcccttttgcgtattcatcttcaaacagctcatcaagcacttcgtctccgagcaattcgccttccgtctggtcagccatgcgaaaaccggggtcaagatcaatcatataataatattttttaagcacttgcagacagaaagagtgaagcgtcgaaatgctcgcccgatttaatagagagagctgccgtctgatatgcagagatcccggatttttggcgagctctttttctaatgcttcagcgatccgatgcttcatctccgctgctgaggcgtttgtaaaggtcaccacaaggagcctgtcaacatcaacaggatcttcctccgcggttatctttctgatcatccgttccacgagcacggccgttttacctgatccggctgcggcagcgacaagaatatcgcggccggaagaaacgatggcgctccattggtcatccgtccatatgctgtctttcggtttaggaatttgcatcatcatccgcctcctttttcagccaatccagtatggtgccgtctttttccgctttcaggctgcggtattcattttccttaagcgactcatcaaactggcaaaccgatttaaacgcacagtacgtacaaggcgtcttatctttcagcttatacggggtaatggacacaagcccgtccgttatcgcttcgcccgcctgttcaaatgtccgccgcacgtggtctgtcagcagatgaaagtcctgttcgctgaccgccgctgagtcggatcttaaagacccgtcctttttcaaaccggcattgacgatatttgaacgcccttcctccaaagtcgtgtccatcaggctgatcgcctcccggtcaccgaggagaaggcctttcattttaaatttcttgaaaatttcctgctcgatttcatcaagccccatcggcagactggcctgaatcatcggatcatggatatggaaatacaaaacgcctgccggggtcgctttcatgccgagccaatccgcagaatgtgtaatcgataagtcaagatatgtgagcatttgcagagcgagcccgtaatacacctcagccagatcaagccccctgtcgcttgatttataatcaacgattctcagcagcaggccttttgaactttccgctttatccacgcggtcgatccgtccgacgagttccatcgtacagccgtttttcagcgtgaaagtgagcggaggcagcggtccgcttccgccgaaaccgagttcaagaccgaccgggacgaaaccgctcgccttcgcatgctcgcttaatatgccagaaacacgcgtgacgatcttctgcagtttttccttcacgtaaaagtgtctgtttgagctgagcagaatctctttttgcagctttggcgcaagccgttccaccgcttcataggagaaattccggcactgatctttcgtcagatcgcgccattccagcttctgctcacgaagccggtctgaaatcagcttcagactggagtgaaacagctggccgatatccggcgcttccagcttgaaaaactgccgctcttttaattgcagcccgtgagatgcaaaatgagaaaactggcaggcattaaacgcctccatccgggaaacgcttcctttaatatgctcgccgtaaagctggcgcgaaacaggccgttcaagacgcttcgcctcattgcggaaaaataggcttgaaaacagctttttcgcacgctggtgatcagactctttcatcagcacattgtatgcgctccaccatacgtcactgatctcgtactctcttgtccacagcctgagctgacttgccgtatacgtctgagccacctgtttattgacgagatactgaagctgctcttcttcgcttacctgctcgggatcagccgctgacagcttttcctgatgatcgggaaacagctcgccaagcctgtttacaacgattgacggcaggagcgtttttccttccgcatcggcaatcgggtatgacacataaagacggtcagacggactcgacagcgccatatagatgagaaaatgctcatcaagcagccgctcacgccccgcggaagacagctccactccgaccgctttcagccactcccggtcatcatcagacagcacgccgttttcatccgggcgcgccggaagaacgccgtcattggccccgatgacgaatgtgcaggacgtgccgtatattcttgagagatccatattccctacaaatacttggtcaagcgcaggaggaattaaagaaaaatgaagcgattccgttcccgtttcaagcatttgctggaacagcgccaaagatatttcatcttcacccatcatgccggcaaactcctcgagaagctggataacggcatcccacgcctggccgtgctgctgcgcttcgatcatgtttccggcctcttcggcccgctgccttttccggtccagcttcaggggaacatcggtatcttccaaaaagagataaagagcctccgccatgctttgaaccgttttcgcttttttcatccggttctgcagccggataaggggtgcagctatccactctctcgtctcattcagcatgtgttccatctcgatttcctgatccgtctgcgcgaaatcctcatcgagcgatacgaagcgcctgtatacaaaccgctcgccgttcgtccagcgctcccctttaatgccgtaggcgatacagtaattttcaagctgatctacctgctctcttattttctgctccggctgatcaagcgggaataacagttcggttttcgcacagcggaacaccgcttcatatctccagttccccttcacgacatccaggcttgaacggatgaattcaataagcgggtgatgctgcatagaagcttttccgtcaataaaataaggaagcccgtaatcggcaaacacttccttcagcaaatctttataatcttccggctgacggatgagaatcgccatatctttgtaccggtatcctccgtcccggacaagcgattgaatttcccgggcaataccttcgagctcagctcttctgttttgcgcctgcatgacggtaaaagcttcctgtccgccggtatacgcggcggcgggacgcacatcgtactgcgactctatacaggcaagctccggcacatgccgatgccgcttcgtgccatgcagttccttgcaggaaatatcggcattcaattcctttgccgtctgataaagcttatagtatgtgcttcccgtcattctgaacagatcgagctcatccggtgcctgttccgccgaagggctgtccgccgtcagcgagaatgtgacatgttcagcatgcatgatcagctgctccagcacccttaattcctgcggcgtaaattgatagaatccgtcgacgtaaacacgggcgccttttacaacgtccgccaaaggaatctgctgagcgagcagcgtcaaatagtcctccgaatgcagatagtgtccggcgaggcttctttccatctgctgatataaaatgcctaagtcatgaagtttttcagacagcatccgctctccgcgatactctgacgccgttccgctttccgccatgcggcggacgtcttcaggctcaatacagtatcgcttaaactctgtcagcatccgttccacctgctcagtgaatccggctttgtcactcgctttttgatacactttaaaatcgtgcttatgttcttcaatcagtttccttaaaagcatctgcacacccgtcgtcgtcacaaacggacggttcatgcccccggtatgctgaagcacgcgccacgccaaacgcgaaaaactgaacacttgagcgcgtatcatgcctccgatatccggcgttttagcaagctcatattccattaaaaacgtcatttgatccgggactagaaaaatgatcggtttcccgaacggctcccggcgcagttcatcttgaatgctgtcgataatcagcctcgttttcccactccccgatctgcctactaaaaactcaacacccaaattagaagacccctctctttttatctttctacattttatcgaaagttgacgaaaatgaccaatctcatctgctggtaaaaacgggatgactgttttaaaacatatcgtttttgaccaaattaaagaaaaaaaggattaaatatgatgtcagaatatcccgaagtgattgtgcgaacgattctgtcgttcagcattctgtttatcggcgcccgtatactcggaaaacaaaccatttcacagatgacgctttttgatttcattgcggccatctcgctcggcgccatcacagccaatctgtcgtttaatacaaaactgccgattcattttactgtcagtgcttacacgatttttgtggttatcatttatcttgtcgcatatctttctatgaaaaacagaactgccaggggtttctttgcaggcaaaccgaccattatcattcaaaacggaaaaatacttgagcataatatgaaaaagatgcgctataccctcgactacttgaaccagcagcttcgtgaaaatgatgtatttgacatttctcaggttcagactgccatcattgaaacaaacggcagcatgtcagtggaggtcaaaccggaatttgcgcccgttacaagacaggatctcggcatctttgccggacatgaaaagaactttgccgttgagctgattatggacggccggctggtaatgaaaaatctggaagaaaaccacgtatcggaaaaatggctgagagaagaattggataagagaaacctcaaaccggaagacgtcgtatacgctgtgcgcggaagcaacggccggctttttgtcgacacatacgacgaccatattacatcgccgctggatcaagaataaaaatgacatccgcacatgtcacgggctgccgccgtataataccctataaacatccgggggtgagtccaatgcacgagaatttttttcattatacagccatctgcagtgacgattctgtgcttataaaggatctggtaaaatccataaacggtgaatacagcgctgtgatttgctactcaatattagccgaaaaagcgccgaccgcagaaatcagaagacgaatcgaacatatcagagaggaagaagtgcgccacatgcacgctttctcttcactgtatacgtcaattaccggaaaacagttgacgccgaaacagacggagcattgtccgcacacatacagagaaggactgagggcggcgttttatgatgagcagaaaacgaatgatttttatttacaggcatccgatagagcggtgcatccggaagcgaaacggttatttgcccgcacggcatttgacgagcagcgtcatgccgtctggtttttatacgatatggcccactctcctttccaccatacagggggaacggtatcaaactcgccgaacacaagctacaccgaggtaaataccggaaaataacgattcagacgctccccgctgggagtcatagacggcaaaccccgttctttcaacaggagagaatggggtttatttttcgagccgtttttatacttccactaaacaatggataacttcttcattgtatagtcagcaaaaaccctttataataaaataaaccaactggtcggttttaaacgaaccgagccccgctttgccgggacaacgatatgaatgaggcggaaaggatctgtgtgaagtgacaaatacaaaaggcggtgccggaaagagcgaaaagacgaagaacaggctcgtatccgcttcgcgtgacttatttgcaaaaaaaggatattcagaaacatcgattcgggatattttagaggcggccgagatcagtaaaggcaatctttatcaccattttaaaggaaaagagtttctgtttcttcatatcatggaagaggatcaccgcgtgatgatcgagacgtggagggaaatggaagctgatctgaaagatgctgccgaaaagctgacgggctttgcggagctgctcagccggatgagcatcaattacccgcttatgagagcaagtgaagagttttatgcgagtgcgtttacgtcagaggaggtcgtaaagcggctcaacaaaattgatattgaatatgacgatgtgatgagagagatcttagaagaaggaaatcaagacggaagctggtccattcatcatgtcgaatcaaaagtaaaaatcctgctatccgtcttctacggtttagatgtgttatataaaaacgataccattcagcaaagaatcgaattgcaaaaagaagccatctccgtgtttattcacgggtcgatcaacgctgataaactgaatgacagctgacaaaggagaaacaacatgcaaaaaccgatcagagaacaaaaggctgtactcatcatcttattaagcaacatatttattgcgtttttaggcatcggattgatcattcccgttatgccgctgtttatgaatgtgatgcacttgacgggcagcacaatgggataccttgtcgctgccttcgccgtcgcgcaattaattgcatctcccattgcggggagatgggttgaccgtttcggcagaaaaatcatgattctcgccggactgtttttgttcgcattatccgagctgaccttcggattgggcacacatgtctccattttatatttcgcaagggtgctggggggcatcagtgccgcttttatcatgcccgccgttacagcgtatgtcgcagatattacgacggtgcaggaaagatcgaaggcgatgggctatgtatctgccgccatcagcacagggtttatcatcgggcccggcataggaggatttattgccgatcacggcgttcgtatgccgtttttctttgcggcgggaattgcatttatcgcagtgatttcctctgtctttatgctgaaagagccgttaactaaagaagaacgcgcaaagcagatggaaagcgccaaagaatcaaccttcttaaaagatttgaaaaagtcgattcatccaagctacttgatcgcctttatcatcgtttttgttttggcattcgggctgtcggcgtacgaaacggtattcagcttatttacaaaccataaattcggcttcacgccaaaggatatcgccattattattacgttcagctccattgtggcagtcctcattcaagtgctcgcgttcggcagacttgtcaacttcctcggggagaaaaaagtcattcagctttgtctgatcatcggcgctgtgctggctttcgtttctacggtgatgtcagggtttttgcccgtgctcgctgtcacctgcatcattttccttgcgtttgatttactgcgcccggcactgactacttatctatcgaagatcgcaggaaatcagcaggggtttgttgccggtatgaactcaacatacacgagtttgggcaccattttcggcccggctctgggcggtattttatttgatatgaatattcacttcccgtttctgttcgcaggtgtggttttatttctcggtctgggattgacgcttgtgtggaaaggaaaagcgggcgaggtttcggagtagggtgcactcacccatctccggagctttttttatgttttcgataagaaaaatgaatggattatgagaaataattcattatttatttatctcaaaatctatactatagtaatagtaaggttaacgagcttaacaatttaatatgaatgtttcaggaagaagggttttcattgaagaaagacaaacatctccttacggatatctggtttattctcatcagtgcggcaggggggtttcttctttcgcttacagggatgtcgatcgcctggatgctcggaacgcttgccgccggctgcatcctctccatgacgaggcccggctggctgttcatggcgcctgacagaagagggattcaccgcagatggcttgcggcgggacaaatgatcctcggcatcgaactcggccagaaattgaacctgtccgttctgtcggttttacgggagcattggcttccggtaggcttcatgctgattttctctatcgtgatggcgcttgtttccggatatgtgctctttcggttcagccggacggacatgatgacaagctttgtaggaacggcgccgggcggtttatccgccatgccgggtatcgcccaggaagtcggcgcaaacaccgcgattgtaagccttattcagctgacgcgcgtccttttggtcgtcatgacaataccgtttctcgtcattttcttatttaccaaacaaaacggtgcggctcagacatcagccggagccgtttcagcaggagcttcacatccgggccttattcccgtcttgttaacggccggatttattttagctgcctggcttgcaagtaaaggcgcaaaacggctgaaattccccgccccttggctgctcggcagcatgatcggcgttgctgctgcggaaatcggcgtgtccgccttggcgggcaaagacatgctggcctggtggccgccggaagcgaaccagctgtcacaaatttttctcggcgccacaatcggatcaaaaatgtacaaaagcatgttcaccggtgtgacgagagtgctgaccgtcggatttatttcttccgtcggattaatcgccgccatgattctgagcgcggttgcggtttctaaattaacgggcatctccatgattacatctgttctcgccttttctcccggcgggatcgccgagatggcggcgacttcgatcaccctgcacgaagactcgactttcgtcgtcgcggttcaggtcatccggatcgttctcgtcatcgccatgcttccgcccttctatcggctgctgcaccacctttctcagctgaaacgggcacacggcgaaagaggccgggcagaaagaggaacatgatccgaataaaaaaacacgcatccatatgcgtgttttttatttgaacagctctccgccgccatttacagaccgccagtttgctgacagatcacggaacagccgttcagcaaataacagttcttcatctgtatagcggtctaaaaacgccaagagccgctgttttatcaattcatgatattcatgatgaagggaatgcagctctttcccggcaggagtcagccggaaatagacttcttttttattgtcactcagccgggttctgcgcagaaagccggcttccaaaaacttcgcgcagcttctcgacacggtcggctttgtcgtcttcattttttccgctattgacgtgacattgatcggttcatgatctccgatacacgacaaaatgtgaatttccgtcaaggtcaattgtaattttttcccgtttccttcgcggagttcatccatccgtccggccaacgacgccctgatatcctcctgacacctctcctgctcgtgaaaaatatcggtcagcccttcaagaatcatgtgttttgcatggtctggctgtcttctgtccaactgctgagtcacccttccgtattgattgtttcttttactataacgttttgttacataagaaacaatcacacaggcgcataaaaaggttatcagatgaataatccccatctctccaaaccggccagaacggcttcttccgcttcacgtcccgagccgccggctgcccatgccgcatggccgtccggccggattaaaacggtgtggacgtcattccaatcggcacgtgtttcagcaagctccgccctgactgccgccacgctgtccgtatcaataccggcgggaatgctccctcttaatgacagaagcacaaagccgcccttgcggagaaaatcatacagccgggccggccgcccgtcatgaagggtcagttcgatatccggcaggcgttttccgttcagggtatgcggcggcagctccgcatccggttcataatgcagatcaagcgcggatacttttcccgccaataaacggttggactcctgaaaatccagcaaagcggtcatcgtttctcttaatgccatccccgactcggtaaaatccatgagctttatctgcgttttgatattgtgcagcacttcttttcctgtgctgtgcctttcctgatgatagctgtccagaagatgaggcgccgcttttcccttcatttgcgccgccagcttccagccgagattgacggcatcctgaagccccgtattcaggccttggccgcctgcgggaaaatgaatgtgcgccgcatccccggccacaaaaatccggccggagcggtactgctcagcctgacgctcggcattgccgaaccgcgacatccataccggatcactcaatccgaaatcagtgccgcatatccgccgcaggtcttctttcagctcatcttcggtgacccgctcttccttccgcttttgcgggacatgcggagaaacgatgaggacacggaaaagtccgtccgtaagagggataatcacaaccgatccctccagccggcacgttgaaaaaaaggaagattcgggcggatgtttcaaagcggcatcacaaagggttcctgttaagtcggcatcagtgcccgaaaaagcgatgcccgcctgtttccggacaatgctccccgctccgtctgtacccgcggcatataagctgtgaagagtgcggattccgctttcgtcccggaacaccgtctccactccgtcatccgtctgggtgacagccaccgcttccgccccgcggatgatgtctgcgccgagacttgatgcatactcctccaacatccgctccgtttctgcctgtggcagcattaacgaataattctgcttcgtatccagccgagaaaaatccagccgtgtatccagcatggaaaaatggccggaagacaccttcgtccctttttccaagaagcgttccaatatgcctctcatggcaaaaagctcaagtgtgcgcggatgcatgataagcgctttggaatacggcatcgtcttcttcaatcgttcaatgacagtcgttttcactccggccagcgccagttctgatgcaagcataagcccgaccggacctcccccgataatggcagcctgtgttttcatttcatcagccctctttcatatttttgttgcgcgcgtaacaaaaatatgaaaaataaaacacctccttttttgtttcgcgcgtaacaattttcattatagtctttcctccgctttttgacaatcatttccgaaaaaaagacgccgttcacttggcgtctgattcactgatgactccgacaatgtctttatccttaatcggaccgaaatgacggctgtcgaggctgtatatgcggttgtcgccaataacaaagtattgtcccttcggtatgcttttgcgcccggtcgtttccttcagcgtataatcaccagtcacatggctcccggcggacaatgatgactttaacggttttaaaaacggttccgccacccgttttccattcacatacagctgatcctccctgtatgcgattgactcgccggggagcccgatgacacgtttgatcagcactttgcggtgcgggcctttaaacagaacaatatcgaaacggcggatcgttttgtaacgatgggaaaacttgttgaccatcagctcatttccttgtttaaaggtcggattcatgctgattccttcgactttataatcaataaaaatggcattctttaattgtatggccaaaacaacgataagcacgccggctataaaccaaaatcgttttttcaagattcctgtctccctccgtctttctcatgctgactgattctcgtctgtaaacgccgttcgatatgctttccggcataccacagcaccgcgatcaccattatggcgcccgccatcctgaaaggctgtgtaatgagtgcgtgaagatcatacccgataaaactgatcataaagatcataaccattttccccatcgcggctgctgatataaactgcagcgcccccacccgtgacagaccggcaacgatatgaaccgcagcggacggcgtaaaggggaagcaaagtaaaataaacagcggaccgaaaccgtgccgctcaacccagagcatcatccgccttatggtctgatgcctgcggatgaaaccgaaagctcttttctgtccgaaacggcggacggcataaaacatcagcatcgatcctgacgcagacccgagccatgacagaaaaaaaccttcccacaaaccaaatgcattcgtattcgccaccacaaatacaacgagcggcaaaaacggaagaaacgcttcaataaaaggcaatacagccgcagccgccgggccgaaagctctatagctttggaaccattccgtcagctgttcctcagtcaaatatgataaaaaatgctccaacgtttatactccttaacgagtttgtctatccttattctacacattatctccaaaaaacgaaaatgtttacgagattttccgtcttgaaatatcgtgtaagcgagtataaaataagaacaaacgttctcttttttaagaaagaaggagtatttatgcctgacattcggagcggcacccgcgatctcatcgaaaaagggctgtttctgcccatggcggccgccatcctgaaccgggacctcgaagcgcttgattcgtgcccgttcaaattaaaacaaccctataaacagcttatcagctgctctttaaaattagcacaaaaggatttgagtgatgttcgaaaagagttaagaaagcgtaaaattaaaatatacgaagcggaaagagacgaagcatttacgctttatatatgcaccattaacggctatgaagaaaaacaccgttatttcaacccgagaatacgggaacaggtcaccgccttattggaatattacctgtctcttgcgaccatttaaaaagcagccgggcctgcttttccttttcaaaaaataaaattcagactattcacactatacattcgacatgattttctttataatcgggacacgctgttttcaatgaaaaggaggaatgttatgaaactgattcatgttctcgccgccctgccctttttcggaattctcgccggcattccatttgccaaccgggtgacgccttatgttttcggaatgcctttcattctcgcatatgtcgtcatctgggcggtgctgacttccgttctgatggccgccgtttacaaattggacaaagaaaacaaggcgggtgagacggaatgaatgcagcatttcccgtaatggccgccgtgctcctgttttgtgtatatctcggaatccgggcccgaaaaggaaaacatatggaccttgaacaatggacggtgggcggacgcggcttcggcacgatgtttgtctttttattaatggcgggagaaatatacacgacctttacattcctcggcggaagcggatgggcttacggaaaaggaggccccgccttttatattatcgcgtacggctgccttgcctacattttgtcatattggcttctgccagccgtgtggacttacgccaaacaacacaaactgatgtcgcaatcagattttttcatttcaaaatacaacagcccgctcctcggcattctcgtatcgctcgtcggcatcgcatccctcatcccctatctcgtcctgcagctgaaagggctcggattaattgtttcagcaacgtcatacggacagattccgccctccgccgctgtctggatcggcgctgtctccatcacgatttatgtgatgatttcaggaatccacggttcagcgtggatatccgtcgtcaaagatatcatgattttaggcatcgtcctgtatttaggtatttatctgcccattcattattacggcgggtttacggagatgttcaaacaaattgacgccgcaaaacccggttttctcacgctgccggaaaccggacagagcgtttcctggttcagctcaacggttttgctgaccgccctcggcttttatatgtggcctcatacctttgccgcttcctattcggcggagcatccgcgggtgtttcggaaaaacgcgatcatcatgcctctttatcagctcgtcctgctgtttgtcatctttaccggatttgcggcgattctgcaggtgcccggtttaaaaggggcggacacggatctcgccttattaaagctgtctgtgaaaacctttgatccctggtttgtcgggctgatcggatcggcgggcatcctgacggcgcttgtacccggttcaatgatattaatggcctcaagcacgctgttcgccaaaaatgtgtacaaagccattctgcccggcacgactgacgaaaaagtctcacggctcgcaaaatacgccgtacccgttatcgcgctgatttccgtatattttacgctgaaaggcggaaataccatcgtcaccttgcttttaatgggctacagccttgtcacccagcttttccccgccctcttattcagcctgccgaagcggcgtttcatcacaagccacggcgcttttgccggcataacggccggggtcggaacagtggccttcattacgctgaccgaatcaaccgtcggaaccctctttccgtttcttccgcagatcattaaggatatgaatacaggcatcatcgcgctggttctgaacattgccgtcatgtttgccgtcagcgccgcagtcagaaaaaaacaaatcagcgcagccgaaaaggcggcttaatgataaaatagcggtaagacacatgaagggggaaagccgcatgatcatgacaacgaccgaaaccgtcgccggaaaacagattacggaagtaaaaggcttggtgacaagcagtatcgtccagtcccgtcacatcggaaaagatttgcttgcaggcttaaaatctgtcgtcggcggcgaattgaaaagctataccgaaatgctggaagactccaaaaaagcggtgaaagagcggctgatcagagaggcggagcagctcggagcgaacgccatcgtcggcctgcggttcgaactgaccgcaggacagaacacatccgaattaatcggatacggaaccgccgtcaccgccgaatccatttaaaaaaacaagcctctttagagaggcttgtttttttatttctcacatgcgatatagtctttatcccggtcaagtcttttatttgcattataaagcgcttttgatacatacggcttgtactttgttctgccgcccttgtttttcactttcgacgatttggccacgccgcccttatacaccttattcagcgccttacagttttgatacgtttttacctttgttttcgcttctgccgtctgccccgctccgtatgaacaaccgaacaccaggccgaaagacaaaagcacagctgccgtctttttcatttctatcctatcccctttcctgaatcatgttgtatgactgaacatatcatagttcaaataatctccatttacaagataaataggaaaatagttttaatttacgtccgcccgtatatcttttatggaatttttcccaaaaccttttataatatgaattgatagcgctatctgactatgatgataggaggagaaatgatgatgaaaaaagggcttgttgcgggtgttctcactacagccgttctattcggcgcatgtacggcggatattccgggggtgatcagtcccaatacggcggaagcggcgtcccagctcagtaaaggaatcggcggaagggcctatctgaacagcacgggctcagttctcgtcacgaaaattcagcttccaagctcgattcaggtgtcaaatgggacagcctatatttactcaggatttaccggaggcacagaggctgatatcgggcttcagtacagtgacacctatcatgtatggaaaccgatcatgaaagtcggttcaaagggacaaggccaggtccggtatctggaaggagaaagccaattcacttatacgaaaggcttccggcccggcagcaccgtacagctgaccatttacaaaaatctgaacggcaatacccgcgccacatattggggcacgaataatgacggatacaccggccgcatcatctcagaactcgcccaaaccaatgtaggctctgtctcaaaatggaaagcgctcgccaccgtcgcggtcacatcagaggatcagcgcccttacatcaaatcaaacttctcgacagcctttacgaacatcacgatcgacaataaagcagtcacacctgtgattgatacacaggattttgccaaattgacagtgtcaggcagcaccgtcagcatgtctgtcgtcaaataaagaattttgaacgcacgatttctttcatcgtgcgtttcgtaagggtctgccggatacgcaaatcccttatttttcggattacgtttaataaaaaaacagccctcctcagggttgtttttttaacatttctttcattatttccgccaaaacgctgagcagtccgccttatccttgatattaaattgaatcatgcgttcaagcagctcataatacaccggttcagtccattgaattctgaacaaacgggaagtagcgctgtagccggcacgggcaatgtcgtcggcaaaatgcgcaattccagcttcttcgggagaaacacttacatgatgctttgctgccgcaaagccgataataaaggtgccgtgatcggtaaacatcggcgtgttccacttgatctgcggtgttaaacccgggaattgctcagacgtccacgacaggatttcctccattcgcagacgatggtcagggctgtcgatacttgataaatagtctttgaaaacgtccatgtcttcctccttcaacatcacgtccgctaacgccaaaaccccggattttcagctttttctttgatgttaaattcgatgatcttcttaagcagatcatagtgcaccggatcagtccaccgaattctgaacaggcgtgaagaagcgctgtacccggcttgggcgatgtcatcggcaaaatgctccatcgtctctttttcaggtaaaatgctcaaatgattttttgccgcggcaaacataatgatataggtgccgtgatcggtaaatgtcggtttgttccacttgatctgcgcttctaagttcggaaattggtcagccgtccacgacaaaatttcctctgctttgagacggtgatccgggttatcgatttctgatacatattttgcaaacacatccatgcccatctctcctaaaatgaaatatcattactctttacatcatcatagccaacagacggacacgatacaactctatccgggcatgtaaatcgaaaaagcccttcccaaaaggaaagggcccgtccctttacatcacagctttctctaatatctctcccccagctcccgcaaaataaagtcgtagatcattcttgtccgctcttctttcggatacagcatgaattcctgccgcttcgggatatgactgcccatcctgtcctgaaaagtggttctgagataggcggttctgtaaacctgattttcaaaagaatgataggatacttccagttccatcgttttgccgtttgagaacgtgaccgctgtgtcatcaaatgccgtcggttgaaaatctttaacgtgcacatgagatatccagccgcattgaggccttgcagaagaaagtgtagggaataaaaagatgtgatttgaagggtccaccataatcggcggcttgtgagaaattttaatcgcttcatatgttcccgcttttctcccggcatagctggagccaaagtagcggcagcttctgtcgatgatgtgaatcggcttcatgctgacatacagaatgcagtctttttcaatgaccttcgaccccattttaccgtctatttcctcaggcaaaacagcgatggttgaacgatttacttcgtagctttctaagggtgcgtgtgttttctggcacatgatgtgcagcctccaatccttttcttgaaaatttatactaataatctatcatctgtaattggaaaacgacaggttttttttgaatatagctaaaaatcaccttttaaagctgtaatttagtcttaaattactatttaaatattatttttctttttcatttcacctcatttatacaatgatcattttcgttttttcgtcaatttgcaggatatgtcgatatatttccaagtattagttatctaaagattataaaaattaattgatttttccggccgttatccatatactataaaaaaggcattggggggattctttatgaaagagaaaaagtcgtacactgagctcatgaagtcccgcaacacggaaaaagcaaacgaattcgatgtgacaatggccgatatttacattcaaatggtgcttgatgaatccttgtataaacgccggatcgccatgctgacaatgcagattaataaggcgcttgatgataaaaataaagaagcgttcctcacgctttcaaaagaatatgccgctctcaaacagagtgaataagccaatccatatggattggctttttttacattatccgtttacgatggtgccgccgttcacatgaatcgtctgtcccgtgacataggaagaatcatcgcttgctaagtacaaatagctcggcgccacttcaacaggctctcccgggcgctgcatcggcacgtctgagccgaagacttccacttccttcgccgagaagctcgccgggatcagcggcgtccagatcggccccggcgccactgcgtttaccctgatgccctgagtgacaagagattgggaaagagatcttgtaaacgtgacgatcgccccttttgtcgctgaatagtcaatcaatgttttgtggcctttataggcggtaatggaggccgtattaatgattgaacttcctcttttcaggtgagggagcgcggctttcgtcaagtaaaacattgaaaaaatattcgtctgaaacgttctgatgagctggtggctcgtgattttctcaatccccggctgcacgtgctgctcacccgcgttgttgaccaggatgtcaatggaaggaaaggcttggcccgcctggcggatgacatcgttgcaaaaggcttcgtcgccgacatcccctgcgatcagcagacacttcgccccttctttttctacatattgcttcgtctcttcggcatcctgatgctcatcaaagtaaacgatgaccacattagcgccttcctttgcgaataaaacggatacggcgcggccgatcccgctgtctccgcccgtgatgatcgccgttttcccttcaagttttttcgccgctttcggtttgtcaaaaacggggcgcgggtccattacatattcaaagcccggctgccggttttgatgctgcggcggcaaggttttcttcttctgattcgccattttgatcactcctttacattaattactatattatgagtaatttgagcatcttatacgaatttcatgtatgaacagagtcttattggaaaaattaagaatatacaacagaggaggtaaatctgaattgactactttttcaaacgaggaaccggcttcctattggaaagcaacagctgacattccttcctttcccgccctcactgaagatacggaatgtgacgttgcggtgatcggcggaggaattacgggcctgacaacggcatacgaactgacgaaaagaggtttccgtgtcgctgtcattgaagcagaccggattttaaacgggacgaccgcgggcacgaccgcaaaaatcaccgcccagcatgatttcatctatgccgatcttattcagcagatcggcctgaccagcgcaaggctgtatttcgaagcccatctccgcgccatggaagacatgaagcagatcatcaaggacctttcgattgactgcagactgattgaacaagacgcatatctttacaccaatacagaatcaggcgtcaaaaaaatgcgcagtgagcaggaagcttataccaagctcggtattgaacacgagcttgtgaaagaacttcccgtccccgttgattgcaggctcggcctcgccatgaagaatcaggcgcaattccatccgcttttatatggtgcggcgctcgtcaaagagatcgttaaaaacggggcgcggatttttgaacagacggctgcgatcgacataaaaaaagaaccgcagccggaagtggtcacgaaaaacagacacggcatcaagtgcagctacattgtctgcgcttcccactttcctttttatgacggaggcgggctttatgccgccagaatgtatgccagcagatcctacgtactcgcggtaaaaccgaaacaagcgtatccggacgggatgtatctcagcatagacaagccgtccagatcactgcgatacaccgatttgaacggtgaaaaactggtgcttgtcggcggtgaaagccacaaaacaggccaaggaaaagaaatgtccgggcattacgaagcgctgaaacaatttgcggaagacacaatcggagttgaaagcatcccatatcattggtctgcacaagaccttgtcaccattgacaaaattccgttcatcggtccgatctcaggcgatgaagaacatattttggcggcgaccggttttaaaaaatggggcatgacaagctcagcgctcgccgcgaagcttttggctgatcatattcaaaacaaaaagaacccgttttccggcctgtttattccgtcacgcttccacgcagatcccggactgaaaaaactgatttcctataatgccgacgtggccaaacaccttatctcgggcaaacttgagaggccggacgcttcgcctgagagtcttgggcccggggagggaaaaatcgtaacggtaaacggcaaacgggccggcgcctataaagatgaaaaaggctgtctgcatcttgtcgatacgacatgcacccatttaggctgtgaggttgaatggaatgacggcgaacggacgtgggactgtccatgtcacgggtcccggttcacacccgacggcggggttgccgaaggtcccgccatcaagccgctgaaacgtctcacccaagattgactaaaccattctgtacgaatggttttatttttttccgcattaaaatatttttatcagattccttcattcaagttccttccaaaccgataaaaagaaaaagagaatatctgggggaactaatattgttatttaaaaaagaccgcaaaaaagaaacagcatatttttcagaagccgatggaaaaaaacgcatcgcgctttcaaatcaatatgcagatgtccaaaaacagctgaaaatggtcaggctcggaaacgaagaacttcatgtgcttgaagagctgcagccgttaattaaagaacatatctcaacaatcgtcgattccttttaccgaaacctggatcacgaaaaatcattaatgacgatcattaacgaccacagcacggtcgagcgcctgaaaaaaacattacggcgtcatatccatgagatgttcgccggcacaattgatgatgaattcattgaaaaaagacagcgcatcgcttccatccacttgcggatcggccttgaaccgaaatggtatatgggagcgtttcaggatctgcttctgtcgatgatgaacatatatgaagcaaccattccggatttgcatgagcttttaaaagcgatcaaagcgacgacgaaaatattgaatcttgaacagcagctcgtccttgaagcattccagactgaatataactgccagcgtgacgaacaagaggaaaagaaagcccgtcttcatcagaaaatccaggaaacatccggatcactcgctgatttgttttcagaaacgagcagagccgtgcaggagctggtcgataaatctgagggcatttccgaggcgtcaaaagccggcaccgtcacttccgtacatgtcgaagaaaaatcaatcggcgggaaaaaagagcttgaaagccagcagcagcagatgaataaaatcgacgccagccttctgcagattgaagaagaaatggacaagctgaatgacatcgcccagcagatcgaaaaaatcttcggcatcgtgacggggatcgccgagcaaacgaatctcctgtcactcaacgcttcaatagaatccgccagagccggagagcacggcaaagggttcgccgttgtcgcgacggaggtaaggaagctttcagaggatacgaaaaaaaccgtttccaccgtatcagagctcgtgaacaataccaatacacaaatcaacatcgtgtccaaacatattaaagatgtaaacggacttgtaagcgaaacgaaagaaaaaatgacgcagatcaaccgtctgtttgatgacatcgtccaaagcatgaaaacgagcaaagaccagacaggcaaaatcgacgttgatttgcaggcctttctcggcggccttcaagaagtcagccgcgccgtttcccacgttgcatcatccgttgattcacttgttatccttacagaagaataaagataaaccgaccggcctttttcataaagggccggtctttttaatgttaacttaaaatataatagagttgacatatataaagactcgctttattgtataaacatattttgataagctggaggaatacataatgaaattgacagaaatgatgcatattgccgtgtttaccgccattatgggacttttggggctgcttccgccgcttttcttatcctttacgccggttccgattacgctccagacgatcggtgtgctcttatcaggaagcatccttaaaccgaaagcggcatttttaagccaattgctttttttgctgattgtggcatgcggagcgcctctcctttcaggcggaagaggcgggttcggggtttttttcgggccgagcgccggatatctcatcgcatatccgctggcggcattactgctgagcctcagcatccaaggccttcgctcagctgctgtcccccatttgtttatcagacagttcttgttcggcgtgctgtttttgtatgtcatcggcattcccgttcaggcttttataatgcacattgatatcttgactgccgtaaagctcagcctcatctatgtgcccggagatctgcttaaagcggccgcagcctcattcgcagccgtaagaatcagaaaaactcttcaagcaagccggcttttgccgacgaaaggaagctgattttagtcatcatgattacatcatcatattcagatacagccggacaagcgccggaacggatcgcaattcagacagacacagaacagatcacctatcaaacttggaacaggctagtaaaccaaaccgcaaactggcttggcagcctttcagataagccggaaaacattgcaatattactgccgaacggcatcccatttttacaacttttcgcaggggcggcgcatgccggctgcacggcggttccgttagatccccgctcggctgcggcggaactcgcggaccagctgcacatcagcaaaaccgacctcgtcatctgtgaccgccggctgagcggcagactggacggcatcaaaacgcctgtcatcctgtgggatgaatgcgggcctttgatcgaggcggaaaaaacggaaggcacttttatcaaaaacaccggcctgcccttttataccggattcacctcgggatcgaccggtaagccgaaagccttcacccgctctcaccgttcgtggctggagagcttttcttgtacgaaacgtgaattcggcatttcccctgatgacaaagtgctggtaccgggcacgcttcgctcgtcacactttttatacggcgccgtcagcactttgtttatcggcggaaccgtcctccttcaaagaaaattcaatccggccggaatgaaagaccggctcagacaagctgacgttctatataccgttccgacaatgacggacgccctgctctcactagaggcgtttccggatacaccgctcaaggtgatttcttccggtgcagactggcccgcttcgtctaaacaagcgctgtcagagcgctatccccatttacggttgtacgatttttacggaacgtctgagctgagtttcgtggcgttcttatcgcctgaagacagcgcccggaagcctgacgcggcgggccgtccgtttgaaaatgttacaatcgaaatccgccggcccggcggggaacgctgcatgccgggcgaaacggggaagatttttgtgaacagcccgatgaaattttccggatacatcaacggcgcaaaacctgatgattccggctggatgacggttgatgacatgggatatatcgatcgtgaaggctatctttatatcgaaggacgtgaaaacgggatgatcgtatcaggcggcctgaatgtattcccggaagagatagaacgtgtgctcaaccgctgtccgggcgtcagaaaagcggccgtcatcggcattcctgatgattattggggcagcatcgccgttgcggtgatcgacggacatgcaaatgtaaaggaactgaagaaacagtgccgcgagcagctggcggcatataaaatcccgaaaaaatggctgttttcagaaataccggaaacagccggcggaaagatcgcccgtgccgccgtacaaaagcaggcaaaggacatgatggaatggaagctgtaattacggatgcgaagcggacgattttcgcccgggaaaacggcctgttaaaagactgtctccccgaagatttggcagctccgctgatccgacatttgagccggaacatgcccgaagacattgatgaagtcctgatcggaaacgcgacgggccgcggcgggaacctcgcccggctgtcagccttggccgccgggcttcctttgagcgtgtccggtacgaccatcgacaggcagtgcggttccggattggacgccgtgagggtcgcgtgccactttgttaaagccggcgcggggagcacatacatcgcgggaggagcggagagcagcagccgttcccctttctcatcccgggcgcgcttttctcctgaacacatcggcgatcctgatatgggcatagcggccgagtatacggcacaggcttacggcgtaacgagaaagatgcaggatgaatatgcccttctcagctatgaacggagcgtcaaagcgcacgaagacggcttgtaccgccgggaaattctcccctgtcacggattcgccgctgacgaaaacatgctgaaaaagcggaacatggggcctctcatcgcccgcgccaaacccgtctttcagtccggaggctctgtcaccgcggccaacagctgcggaatttctgacggggcggcggcagtttgtgtgatggaagaacaaaaagcgcggtctctcggtttaaagccgggattgcgttttatcggaagcgcggtaagcggcgtccatccgcattatccgtcagcagctccggtttatgccgtcaaaaagcttttgaaggaacgggacctgtcaccggatgatattgatatatacgaaatcaacgaggcgtttgccgtcaaaatatgcgttttttcacagcagcttcaagtgccgtattctaaaataaatgtccggggcggcgctctggccgtcgggcatccgtacggggcttccggagcggcgcttatcacccggcttttttatgaagcaaaaagacgcccggatgcccgctacgcagcagcagcgatcggcagcggaggcggagtcggactggcgcttctctttgaagtgttaacgtaacggcagtataatagatgatatcgataaaaaatgatcggagtggagactttatgactgccgtttgtttagtaagacatggagagactgattggaatgcccaaaagaagcttcaaggcaaatcggatattccgttaaatgcgacgggagagcgtcaggcgaaagaaacaggagagtacttaaaggggtccgaatgggatgtcatcgtctcgagcccgatgaaacgggccagaaaaacagctgacattattaacgggtttttgaatcttcccattgtcgtcatggaagatttcagagaacggagctacggtgatgcggaaggaatgtctttgccggaacggtcgaagcgctacccggataaaaactacccgaacatggagaccgcagaagagctgacagacagaatgcttgccggtttagtgaaagttcaggagcggtttcctgatcaaaaagtactgatcgtcgctcacggcgcagctattcacgccctcttgtccgctatttctgacggtgataccggcatacaaaacgcaaagcttgtcaatgcgtgcctgagcaatatcgaacgaattgaaaataagtggcgcgtcaaagattacaatgtaagcagccacctatcagaatcataacaaaaaggcccgaattagttttgggcctttttggcgagcatttttttctgaagatcatgtaatacggcgtccgcaccgtcaatgctccggcgctccgtccataccgccctgtccgcgcggtaaacgtgtccgttttttacggcagtcagctgtttccagaggtgatttttttcgagttcttcctcaccgtccaatagtacgatgtaatcaggatcgatatgcaaaagctgcccgggcctcattttgatagcgtctgatttcccgccggaatccgtctggaccgcatatgtaaaccctgcgagcgtcaaaagccgggatgtgaaaaaccggtcatcctttacggaaatgctgccatttgcagcgtcaattaataaaatcgtgccgccttctgcatccagctttcttttgatgtcattcagcttttcttcctgagccgacaattgtttctctatgatgccctctttaccgaccgccttttcaatggtaagggcagcatcaaccgcatcctgataatccgcagcttcatttttcaaagcgattgtcggagcgatctttgtcagctcatggtatatccccctgtgcaggcttgagtctgcaatgatgagatcgggttttaacgaagtgatttttttcaaatcgggatgtgacgggggcccgacggacggactgccgtcgtttcgctctttccggttatccgccgcggccgccggctttataccgagatcatggagggtgtcaataaagccctcattcaatacggcgatgcgctgcgggtgcgcagccacatgcgccgtccccagatcatgcctgacggcggtttcatgttcctgttctgagcatgccgttatgaagagaacggataagatcatcagcatactgaaaattggtttcatctgttccccctctttcgtttttccgcaattatatcattgacaatataagtatcaatgatattcattatcattatttttataaaatggtttcacagcttttctccctcaagaaagtcaaagactgattcatgccggccgctttatttcattccgctttcgtttccatcagacttctgcattcaacaaaaggtgacatttatcctgtttttgcctcagcttccaaaaatggaatcaaaccgttcgacccagtaaacaagagagcgattgcggctgtgtacaaatactcatgtccttccatcggttttttccattaaaatttaaatatttcgggttcctattaaacgaaagagagatgatatacctaaatagaaataaaacaaactgaaaaaaattgggtctactaaaatattattccatactatacaattaatccacagaataatctgtctattggttattctgcaaatgaaaaaaggagtggataaagagtgagaggcaaaaaggtatggatcagtttgctgtttgctttagcgttaatctttacgatggcgttcggcagcacgacttctgcccaggctgcagggaaatcaaacggggaaaagaaatatattgtcggatttaagcagacaatgagcacgatgagcgccgccaagaaaaaagatgtcatttctgaaaaaggcgggaaagtggaaaagcaattcaaatatgtagacgcagcttcagctacattaaatgaaaaagctgtaaaagagctgaaaaaagaccctagcgtcgcttacgttgaagaagatcacgttgcacaggcgtacgcgcagtccgtgccttacggcgtatcacagattaaagcccctgcactgcactctcaaggcttcaccggatcaaatgttaaagtagcggttatcgacagcggtatcgattcttctcatcctgatttaaaggtagcaggcggagccagcatggttccttctgaaacaaatcctttccaagataacaactctcacggaactcacgttgccggtacagttgcagctcttaataactcagtcggtgtattaggcgttgcgccaagcgcatctctttacgctgtaaaagttctcggcgctgacggttccggccagtacagctggatcattaacggaattgagtgggcgatcgcaaacaatatggacgttattaacatgagcctcggcggaccttctggttctgcagcgttaaaagcggcagttgacaaagccgttgcttccggcgtcgtagtggttgcggcagccggtaacgaaggcacttccggcggctcaagcacagtgggctaccctggtaaatacccttctgtcattgcggtaggcgctgttaacagcagcaaccaaagagcatctttctcaagcgtaggttctgagcttgatgtcatggcaccaggcgtctctatccaaagcacgcttcctggaaacaaatacggagcgtacaatggtacgtcaatggcatctccgcacgttgccggagcggctgctttgattctttctaagcacccgaactggacaaacactcaagtccgcagcagtttagaaaacaccactacaaaacttggtgatgctttctactatggaaaagggctgatcaacgtacaggcggcagctcagtaaaacataaaaaaccggcgtcggccatggccccgccggtttttttattatttttcttcctccgcatgttcaatccgctccatgatcgacgggtggctccctctgaaaattttgacgagaaacggcgggttgacccggctcagtcccgtatcggccaagtcctgaaacgtctcaatcgccgcttcccggtttccggtcagctcgatgccgtaacggtcggcggcgttttcctgataccgggagacggcgttcgtaatcggatcagaagcaaaactgagaacggatatgagcagcaataacagcgggagggcggccagatcttcaggcccctttatatgaagcattcggccgaagaatttggacagccgcttataaagcttgtcaatgatataaaacccggctaatgacagcagcagatacccggccagtccgatgtacacgtgcttcatcacatagtgccccatctcatgccccataatgaacaaaatttcccgatccttcagtttgttaagcgtcgtatcccacaaaacgatccgcttattcgaaccgatgcccgtcacatacgcattcagcgcattcgttttctccgacatatttacttcatacacatggctggccggaatgtcggccttgtcggcaagcgacaaaattttgctttccagctccttgtctttcagcggatagaaatcattgtataaaggatcaatcacgaccggctgcaggaaaaacaaaaacagggtaaacggcacagtaagacaccaagcgtaaaaccaccatttttttgtatgctttgtgatcagccagtaaaacacaagcacacacacggcaaacagcggaaaactgatccagaaatcaatgacatggtctcttatccagcttgctgctgtctgcgtcgaaatatgatacgcaagcgaaacccgatatccgatccactcaagcggaagcgaagccgccgtaacgatgagtgaaatcacaaatacgaagcttacgatttgcagcacccgaaagcgcaccgctgcttccagccaatgctttattttttttgcaagccccgtaatgagcagcagaaaaaataaaaaccaatctaacggcgctccgatgaaaaataaaaaatcctttacatttgaaaagttttcagcggctgccaggcggcccgggtccatgaacgaggacggatcggctttcgttccctttacggcctccgggacggcggagtctcctgtcataaagaaataccaatagaaaaaaaggccgtacagcacataggcaagtcccgctgccgctatccatttgcgcatggaagtctccctccttagccttatgacttactcctattgtaagcataaatgcaaataaatagaaccaagcctccgaaacggatgttaatcttttcacaacagaaaagaatggaacaacaggaagcgggaaagactaaaagacggagtgatgaatatgaaaaaaataatcgcgtttattgtagtaatcgcccttttggttattgctttcttctatgtatacagccggaccggcgatgtgtttccatcaagcaacgcagatctgattattctgtcagagaacggaaaaaaagaaatcaaaattaaagacaggcagaatgtaaaagatatgctcgatatcttgaaccaaggaaaacaagtcaaactgaccaaaagcgtgtctcccgattacgacggaacggtcaaataccatgaagaccgttttgattcattcagtatgtggctcgaaagcggcaattatatgatgtacaagcataaaaacacgtattacaaactgacccggcatgatacgaagcttgtgcaaagcatcattaaggaagaatcgcacagctgaccggatcagcatgtaaaagcgaagcccccggcttcgcttttcgtccgtcatttcggaagcatgtcccggaccgcccttctcagcagcttcccggtcgcgttcttcggaatctcatcaagaaaaaccacttccgccggccgcttatattttgccaaatgtgtttcacagtaatcgaaaaccgcctgctctgtcagctcaccgtccgcaggcactatataagcatgcaccgcttcccccgttttggcgtcaggaacgccgatgaccacggcttctttaatgccctcatggctgtagagcacttcttctacttcgcgcggatagacattgtatccgccgacgagaatcatatctttttttctgtcgacgatataaaaataaccgtcttcgtcgcgcttcgccaaatcacccgtgtacagccagccgtctttcagcgcgtgctccgtctcctcgggcatcttgtaatagcctttcatcacattcggccctttcacgatcaattctcccacttgatggtcgggcaattcgcgtccgagcgtatcgacgactttattttcgacatgtaaaatattcgtcccgatcgagccgggctttctcccccggtcaaacggattaaaacaagtaaccggagacgcttcagaaagtccgtatccctccagaatggtgacgtcaaaggtttgttcaaacgtctgcaacagagcgaccggcatggaggccccgcctgaaatgcacagtctgacggacgcaaaatcctccgccttgccgtgctcgtattgatacagatagttatacatcgtcggaacgccggcaaaaatggttgcctgacggcttttaatcagtttaaacacagaagccgggctgaattgcggctcgattaagacacacgctccgctcatcagaggcgcattcatacaaacggttaaacaaaaaacgtgaaacatcggcaatgccgccacaattttgtctttctcattcattcctaagtatccggcgacatcatttgcattggagaaaagattctgatgggtgagcatggcgcctttcggttttccggtcgtccctgaggtgtataaaatgacggcagtatcgtctttggacaatgtcggataagttctgctgcgctccgccgggcggagcatttttgtaaacgttgtcatttttaagcgcaattgagggtcttctgtcgatggagcgttctctgctgtctggctgataatgatatgctccagcagcggcagcgagccgtgcaggctttcaaatacgggaattaataggtcgatgccggcgatcgctttgacatcgccgtttttcagcatgtatgcgatttctgaaggtgtgtatgccggattaacaggtatgacgacaattcccgcttttaacgcgccgaaaaacgcaataacaaaatcaggcgtatttccgagcagcagcgcgagatgatccccttttttcagtcccctgtcctccaagccgtttgcaaatgctttgattttacctgccagctcctcatacgtcatgtactgatcttgaaacagacaagctggtttttccggtttctgcgatgccgtttcttccaatttggaaaccagattcattttcccacccctttaaaaatataatgaatgaatagtcattcatttatccggaataaacgttcacttttattatagaaaaatatagaaaaacactcaagggcaaaaagccccgagtgccgtaaaaccggaaactataattgtttcagcgcttcactgaccggcgtgccgcccgctgtcagatcgaacgctttttcatacgtattcggttcatcaagggatgcgataacggtcttggcgacatcgtctcttgaaatggagcctctttctaaatcggctgcggctttgatatttcccgtgccgggatcatttaataacccgcccggccggataatcgtatacgtcagaccgctcgcttcaagaattttatccgcataatgctttgcggcataatacggcttcagcgcttcattccaattgtcgcggttatgagcctgaagggcgcttaccataatgaaccgcttgatgccggccttctttgccgcttctatcgctttcgccgctccgtcaagatcaatcagaagcgtcttatcgtatccggtgcttcctcctgatccggcggtaaacacaatcgcgtcacagccttcagcggctttcgcgatgtcttccgtgcttccttccaaatctgcaagaacggcttctgttcccgcggcttgaagcgcttctttctgctcttctttccggaccatcgcccgcagcgtatgcgtgccgtctttttgaaacagcccggtcagacgctgtccgatctgcccgtttgctccgatgagaaatactttcatcatgatccctccccattcattatggttctatcatttcacaaaaacgggcgcagattcaaatcatgcgttcggcaaatgttctaataaatcagctcgaggaaatcttccagctctattttgccgaaatactgtttcagatcgattccggccagcgcctccctgatagcggttctgtcatactgttttccggtcagcgcctgttcgacttcactcacatctttcgcaccgaagaaatcaccgaaaattttgcagtcctgaatgattccttttttcacttcaagacgcagatcaatcgatccgaccggataacgtttcgaatgctgaaggttgaatgcgggcgaccttccgaaattccagtcccagttttgatagcgctcttcggaaatcttccggatcgctttccagtcttcatcggtcagtttatattccggcacttcggaaagatcatttgtattaaaaatatggtgaagcagatgttttttgaattcgtccgccgtcattttgtcatcaagaaactcgctgatgttggcgacacggcttctgattgacttaatgccttttgattcaattttgtcttttttcacttttaaggctgacacgacatgatcaatggcggaatccagcattaatgttccgtggctgaaaatacgccctttcgtcgaaaattgagcgttgccggaaatttttctgccgtccgcgacgatgtcgtttcggccgcttaattcagcttccacaccgagctggcgcagcgcctgaataacgggttcggtgaattttttaaaattgtggaagctgtcgccgtcatccttggtgataaaactgaaattcagattcccgaggtcatggtaaaccgcgccgcctcctgacagcctgcggacgacgatgattccgttatcttctacgtatttcgtattgatttcttctattgtgttttggttcttcccgatgataatcgacggctgattgacataaaacagcaggtatgtctgttcagggtcgagatgcttcacgcaatattcctcgattgcgaggttgatcctcgggtcggttatgttttggttgtcgataaataacatggtgctcctcctttatttctcccacttcaatccggaagcggcgattgtcacttcgcccccgaacacggattccgcttcttctttcagcttccggtgctcgccgaaatgaggcagatgtgtgagaatcagctcccccgctccggcctcctccgcgatacgtccggcttccaaactgttcatatggccggctgacgtgccgtcctggtccgcgtaaaaattgcactcgcagatcagcagatcggcattttccgcaaacgggataaacgcgtcctggtagcttgaatcagccgtatacacaacagaagctgaaccgtcagtaatccgcatcgcataacaagtgaccggatgcaccgttttcaggaaggtaatggtgaacggcccggcagaaagcgggcggtccggctgataggccactcctttcgtatgcgttttatatgtaagacgctcaaactgttctatatcagcatcatgcccgtaaatcggcagtgcatgcgtcccttttccgagaaaggagccgacctgtttggcaaattgaagcggcccgatatcagcgatgtgatcatggtgataatgggacaaaatgacggcatcaagctcttctgccggaacataggcaaacagctttgataatacggcgcttccgcaatcgacgagcagagaatagccgccggactgaaacagatagcctgaagttgcttcgtttgcggccggaaacccgccgcagcatccaataactgtaactttcatatgaccctccgaatgtttatgataaaaagatcctttcctccaatatacctatttttcgtacaaattgcatgttttaaacattgtgccaaaacagccgttgattttccaaaactgttataatacaatgtagagacaaaacaatgaaagagggatgggtatgttggaaaagatgtcggattttttcagaaatttacccggtaagaaatgcgaagaatgcggaaatgagattgttgagcagtatgagtgtcacattaatctgtgcaatgactgcttgaaaattaaggatatgtgacaatagggcgccgcacaattctaagttgtgcggcgcccgttttttcggccgtcatcatactttctgaatagggcgttattcaccattattagcaattatctgtacgttttaaaagattcagtattttcaatctatatttttctatagacggattgttttcttttctattataatttgttctaatagctatctttttagatacttattgcacttttttcttcgggaggtaatctatgaaaaaattacgctttggactagcgacgcaaattttcgtcggactcatactaggggttgtagtcggtgtcatctggtacggcaatcccgccattccaacatatttacagcctatcggcgatttgtttttacgcttaatcaaaatgatagtgattccaattgtcgtctccagcttaatcatcggcgttgccggcgcgggaagcggaaaacaagtcggaaaattaggcttcaaaacgattttgtattttgagatcattaccacttttgccattattctcgggctggctttggcgaatctgtttcatccgggaacaggcgttaatatacatgaagctcaaaagacagatatcagtcaatatgttgaaacagaaaaagaacaaaataacaaatctatcgcagacacattcctgcatatcgtaccgacaaacttcttccaatcattagccgaaggagatctgcttgccatcatctgctttaccgtgctgtttgcactcggcatctcggcaatcggtgaaaaaggaaagcctgtcttggccttctttgaaggtgtttctcatgcgatgttccatgttgtgaacctcgtcatgaaagttgcgccgtttggtgtttttgcgttgattggtgttaccgtttccaaatttgggctcagttccctgctttcactcggtaaactggtcggtttagtgtatgtagctttggctttctttctcattgttgtattcggaatcgtcggaaagcttgccggagtaaacattttcaaattcctcgcctatatgaaggatgaaattttattagcgttcagtacgtcaagctccgaaaccgtactcccccgcgttatggaaaaaatggagaagatcggctgtccgaaaggtattgtttcctttgttgtgccgatcggatatacctttaacttagacggatctgtgctgtaccaatctatcgccgctttattcctcgctcaggtataccacattgacttgtccatttggcagcagattacccttgtgcttgtcttgatggtcacttccaaaggaatggctgccgtgcccgggacttctttcgtcgtcctgcttgcgacattaggcgcattcaacattcctgcagaaggccttgcattcatcgccggtgttgaccggattatggacatggcccgcacggtcgtcaatctgaccggaaacgcgctggcatccgttgtgatgtcaaaatgggaaggccagtatgatcccgttaaaggcgcgaaggtcatgagcctcgccaaaacagaacaaaacacaaccatttcaggttaaaatgaaaaccctgcacggaatgatttccgcgcagggttttttatgccatcggcgatagaacgtaccggtgcaaaagcttcgccgtattaagaagcgataattcatgcgtgcgttcaaaagcgtgtgaagcgtcaattcccgggccgatcagcccgtgaacgatgtcatggcccgaacggatggctgctgaggcatcagaaccgtaatacggataaatatcaagctgataatcaatgccatagcgctccgcaagcccggccagatgttttctgagctgataatggtacggtccgctcgcatccttcacgcaaatggagacggtatattcatccgtagactggccgtcgccgatcgctcccatatcaacagccaagtattcgacggtctcaggaggaatgttggaattgccgccgtagccgatttcttcattattagaaatcagaaaatgcgtcgtatacggaagttcgattttctcttccgtgatgcggcggattaaattcaagagcagagccacgctcgctttgtcatcaagatgccgggacttaataaagccgctcggcgtaatctgcacgcgcgggtcaaatgagatgaaatcgccgaccctgatgccgagatcggacgtctcttccttcgtccggacaggctcatcaaggcggacttccatattctcctgattccgctctgccttgccggcgtccttgtagacgtgcactgaagtctgatgcattaagatggtgcctgtataggttttgccggaagaagtttggatctcgcaatattccccttcaatcgagtgatatcggaagccgccgatcaagtcaatcttcagccggccgtccgactttatttcctttaccatcgcgccgagcgtatcgacatgcgccgtcagcaatctgtgtttcttgtcatcacggccgggaattgtgacaaaaagaccgcctttgcggtttctgtaagaggagacgccccattcttttaaaagactttctgtataggcgacaacctcgtatgtattgcccgtcggactcggaatcgacaccagttctttaatcagttccatcgtatgtttcatattttccacaggtcattcctcctatcaattttattcttcttaaaatatactcttttgatccataacccgtccaatcttttcctgctcttttttcatagaatgaagggagcatgagcataggagggaaatgtatgatcagccgtaaaccgcacaagcggaaaaggtttcataatgattggtttgaggattggtttgaggatgattggtctggtgcagccttctggtgctgtaaaaaagaaaaagatcactgtaaaaagaaaaaagaagacccttgtaaaaagaagaaagacaaaaagaagaaagacaaaaagaagcatcatcattcatgccgccgctgctgccgtcattggtaatcgttcacacaagcccgttttacaaataaaattctcatgctccccaaacagcggatgctgcttgggtttttttattaaaattagtaccaagtaataatatcaggtgttataatctgatataaaggagtgattttttcatgtcaaaatctaaaattacagcaatcggtacatatgctccggcacgccgattaacaaacgcggatttagagcgcatcgtcgatacatctgatgaatggatcgtccagcgcaccggtatgaaggaaagacgcattgccggcgaacatgaattcacatcggatttgtgtgtggaagcggtgaaaaaccttgcagaacgatacagcggaactcttgatgatgtcgatatgattcttgtcgccacaacgacggcggactatgcgtttccaagcaccgcggcacgcgtgcaggcttacttcggctggccgcacacgggagcgcttgatattaacgccacatgcgccggactcacttacggccttcagctcgcagacgcattaattaccgccggttcccatcaaaaagtgattgtcattgccggtgaaacattatcaaaggtaacggattatactgaccggacgacctgcgttcttttcggagatgctgcaggcgccctattggtggaacgcgacgaatcagcgccgggctttttggcagccgtgcaaggaacagcgggaggaagcgcggacgtgctgtatcgcacgggactgagcgcagaattaaacggcgagccgcttaaaggcggaggaaatatggtgcaaaacgggcgcgaagtatataaatgggcggccagaaccgtgcctgaggaatgcaatgcccttttagaaaaagccggcttttcaaaagacgatctggattggttcgttcctcacagcgccaacatgcggatgatcgaatccatctgtgaaaaactgcccttcccgcttgaacggacattgacaagcgttgaatattacggcaacacttcatcggtttctattattctcgctttggatgaagctgtgaaagcaaaaaaactgtcggaaggccagacgctggtattgttcggattcggcggcggattgacgtataccggacttttggtgagatggggattttaatcgaaatcaaaaaaaagaggccctgagcatctgctcagcgcctctttttcttatgctgttatttcttcttccgttttgtgttcttttttgctttgcaccgtaaaatacacgatggtcagcgcgatcatgacaacggcgatgcccaacagaatggatgcctgctgccacatatagccgtaatcgccatttgaaatgacggcacggaacccgttgatgctgtaagtcatcggcagtgccccgtgaatcacttgatagaatcccggcaggagttcaagcgggaaggttcctccgcttgccccaagctggagcaccagaatgatgacagcgataaagcgtcccggatttcccatcgttgtcgccaataattgaatcatcgacaggaacgcgatgctggtaatcatcgtaaagagatagaatctccaagtgctttccacatcaagcccgattccttttaacagaaccgtggcgactataacggattgaatcagtccgacgagcagaatgacgctgaatttgctgaggaaccattcaaaaccgtttctcggacgccctgaagcttcactcagagggaatacgaccgtcagcatcaatccgccgacatacaagcccatagagagaatataaggcgtcagtccggtaccgtagttaggcacggaatgaatcgcgttatcgtccgtttttaccggatcggcaaacatgctgtacgttttgtcatctgtcttaatgtccccggtttgatcagccgcatctttcagctggctggacaattgtccggtgccgtctaaaagcttgcttaaaccggtgccgagagacgcttgaccctgctcaattttggacgagccgtcatggattttgttttgcgcgtccagcagtttcgttaagccgccagacacctggccgctccctgacactaacgcttctgatcctgatttgagctgtccgaacttgctgttgtattcgccgataccggccgtcaatttgttttggctttcaaagacggtctgcgctccgctgtacaatttatcagttccagccgtcagctggttaatcgcgtcttgtaccgccgccgcgccgttatacagtttcgatgtggactgaggcagtgctttcagctgatcagccttcgcttttacatctgccagcgcgctttttatgactgacatatccggaagctggatatctccgccggacggaagctggctgacgatattgtctaaatccggaaggtcggccttcggaagcttctcattcagaagctgaacaagtttcgctttttgctcatccgttaagaaatcactgtccttaatcacctttttgaccgcgtcatcccgggcatccaggctgtttttcagatcagaaagctttttcttaaactgctgcaattccttttcagtctgctcaagctccccaaccgctttttcaatatctgagaggttgactgaattgatcgcatcttcaaatgccgccgctttttgcgacacttcctgcgccttgctgtttaacgcgcttaatccattcgttaaatccggaagcttttgctggagctgcttttgtgcgtcaaggctcgttttcagcccgctggccacttggcctcctcctgaagcaatctgccctgatttatcttgaatttcggcgcttgcgctctgaagttttgcgatagagctgtcaagcgtttgaattccgcttgtcactttcgccgctccgtctgcaagctgctgcgttttatcgccgatggtggcggtgctttcagtaagcttcgctaaattttccttcagcttggcgctgccgtctttcgcgtttttcgtgccgtcgtctattttcttggcgccgctgctggctttgccgagtcctttggcaatatctttaaaattgtcaaaaatgacttttgcgtattgctccgtcacttctttcgacacggaggctttcagcttgtcgatcgccttttcgccgattgtcgcgccgacatagtttgatccggcattcgtatgatatttcagatccagcttcttcggatttttatccattaccgtgctggcgtttttagaaaaatcttcaggaatctcgaccaataaataatatttagcatttaataagtcctttaacgattgatcaagatcgtttgaaaaatgccaatcaaaattatcatttttctttaactctttcacaagatcgtcaccgatctgaagatgtttcccttcgtagtccgcccctttatcctggttgacaacgacaaccggcagctgatccaccgtgccgtacgggtcccagtacgccttcaaaaacactccgctgtagatcagcggaacgaataatatggcaatgatggggattaacagtttcttgttcgttacaatgtctttccactggctttttattgtattcaaccctgttgcctccttccgcaaactgactcatttgacaaaacggtcacggcacctaaaaagtgaaggatcatctattatttagataatccttgaccaacatacatttccagcaattcggcgatcgtctctttttcaagaggcggatggtttttttcccagtcaaatatcagcgcgatgtagagcttgagcatcacaaaagcggtcagttccggatcacacggtttaatgcttccgttttcaatggctgtttctatcttttctttaatgtatgacagaatggcccgctccattttcgcaatgacatcctgaacggctattgtaccaatctcggcgttctcctgaaaaattttaatagtcagctggtgtgtttttctgaattccaaaatcgcgacaagcgcccggtgaacattttcgtgaaatgaaagctccggtttcatcgcttcgtctgcgtgttccttcatttctcttaaaatagtggtgaaaatatcatcaaacagttcttctttgtttttgaaaaacgtgtagatggttcccttccccacatttgcaagctttgccaccagatccattgtcgttgctttgtagccgaattgtgtaaaagacttcgttgccgcttccagaatgagctttttccgatcgacggacatgtttcccacctcgttaaattgaccgtttgaacgttttagtcattttgtacataagataacttatcacagtcgcaaagaagattcaaatgttttttctctttattggtgttccctttacagaacgggaacatgcaaaaaacctccgttttacgataacggaggctggtacgtttcaaataaataagcgagtgaatcatatacggcggcttttccctggtcgatacagtcggggatgcccaccccttcgaaagacgcgcccgtcgcgtatacgcccggataggaagctttcagcgcatctctgaactctttgatgcgctccttatggccgacatggtattgcggcatgctttcgttccagcgggtcacacaggtcatttccggttcgccatttattttcattacttttttcaaatcttccattacgattttaatgatctcgttatctgaaagatctacgatggattcatctccggcctttccgacgtacgccctgagaagtgttttgccctccggcgccgcgtgcggccattttttattcgtccatgtgcaggccgtgatggagaaatcgctgtttcttgagataacgaatcccgtaccttcatgctccattttgacggctccctcaggaaaacctaaggcgacgttggcaacggacgtagaatgcatatctttgagacatgaaaccgccggcagatcagaaagcattttcgccgcggctttatgcggggctgtcactatgcatccttccgcatagagcactttgccattatcaagcgtcacggaatatcctttctcctcgcggccgatatgggtgactttcgttcctttcatcacctttgtcagcgtaagctgcttttccagctcctccaccaacgtttgaagtcctgtcgtcaccgttaaaaactggccctgctttttggccgtcagctgctgtcccgaaggctgcggacgtgattttttcataccgagaatcaggcttctgtgcttttgctcagtctgatagaattgcggaaacgtggacatgaggctcagcttatcaatatctccggcataaatccctgataatagcggttctattaaattctcaacgacttcgtcaccgacgcgtctgcggaaaaattcacccagagactgatcttccttcggtttgctcgcaggcaggacaaagtcaagcgccgcccgcgcttttccgggtacagaaaataaaccggtggagatgaacggagcgattttggtcggaatgcccatcaccgcgcccttcggcatcggatgaagcgtctcattgacgagcacgtaagactggccggtcgcattgttgacgagcagatgctcaagccccaaatccttaacgagctgcggcgcgctttttttcctttctaaaaaagaatccggcccccgctcaatgatgtagccgtctttatgcgccgtctgaattttgccgcccgctctcgggcccgcttcgatcagggtgacctcaagcggcagctgtttttccttgatttctttttccatgtagaaggcggcggctagtcccgttatgccgccgccgatgatgaccagatgttttttatcgccactcatttttatcgccttctttaccgtttaattctacttgtccagctctttcagcacgaccgctgcaagcgcgtcgataaattcaggctgtgcgttcggcatggccggacgatagtagcttgcgccgacttcttcggtcacagctttgcattcataatcattatcgtaaagcacctctaaatgatcggcaacgaagcctgcgggcacgtatacaaatgctttataaggatgcttttgatacagctcgcgcgtgagatcctgcacatccggcccgagccacggatcaggggtgttcccttcgctttgccagccgactgcgtaatcggtaattccggcgccttcggcaatcagttttgcggattcctccagctggtcaggatacggatcgccgtattctttaattttttcaggaaggctgtgcgctgagacgatcagcatcgcgtcatcccgttcttctttcggcattgattcatacgttttcttcacctggccgacccaataatcaacgaatttcggttcatcataccagctttcaacagacttgatggtcaagccgccgagcttctccgcttcttctttcgcgcgtttgttgtatgactggacgctgaatgttgaaaaatgaggggcgagcacaaggctgacagcttctgtaaggccgtctttatgcatgtccgccaccgcgtcttcaataaacggttcaatatgttttaatccgatgtacactttgaatgttacgtcgtcctggatttcatttaaacgctgtgcgagcttctccgcctgctcctgcgtgatttttgccagcggagaaatgcctccgatcgcttcatatctgtcttttaagtcttgaagcatgtgcggctccggctttcttccgcgtctgatatgtgtataataacgttctatgtcttcttctttgtaaggcgttccgtaagccatgacgagaagtcccattttctttttgctgctcattttgttaaacacctcttttgatggtctgtctaccttgattttgacaggaaaatcttcttataaccaacgatctgctcaggaagattgttccgtttttttggccgcggaatattcatgtacaaacgccgtcagctttttcagcgttgccggattgacatcagggaatacgccgtgccctaaattgaaaataaacccgtccgttttcatgccttgatcaagtatcgctttcgcttttttctcgatgacttcccaaggcgcaagaagaagcgacggatcaagattgccctgaaccgtttttgtaatgccttgttttctggcgtcatctatgccgagtctccaatcaagaccgacgacatcaagaggaaggtcatgccaatccccggccaggtggcttgcgcctacgccgaacatgatcagcggaacttgctctgctgaaagctcccggaatattctgtccatcaccggttttataaactgccggtaatcttcgcggttcagcgcgccgacccatgaatcaaaaatctgaatggcttttgcgccggcattaatctgcgcttttacataaacgataatcatgtccgcgagcttgtccatcagcatttgccacgcttgcggcatactgtgcataaacgcttttgttttgttgtaatttttagaaggcccgccttcaatcatataactggccagcgtaaaaggcgctcccgaaaaaccgatgagcggaacattcagctgttcgtttacgagtaatcggatcgtttccagcacgtaaggaacatcctgttcgggattcagttcgccgagcttttcaatatccgcagcagagcgcaccggctgatcgatcaccgggccgattccgttttttatttcaacatccactccgatataaggaagaggcgtcataatatctttatataaaatggcagcgtccactccgtactgctcgaccgggagcctcgtcacatacgcgcacagctcgggctgatgcgtaatttcgactaagccgtacttttctttcagcttgcggtattccggctgagacctccccgcctgtctcatgtaccagacagggacgtgatttgttttttctccccgtgccgcttttaaaaacgtatcattaaacgcttctcgtttactcatctgaatttccacctttcctcctgcaaccatacgttcgtgttcttcgcccattacactataccttgttttttctgaatggtatagaattgaggcttaatgttcaaaaaatcgccgaattcatgattaagaagaaaaaagcttcggctgaacgtattccgttccctctccttcttgattcgtctgcgaattaaatggaacgactttgtatgaagcccctgaaaacagattggcgtacggtatgtcaaagctgccttttcctttcaccgaatccagaagcttgtcttttccgtctttcttctcatatattcggtaaacaacccgatcatccttttgaatatcccattttaattgaaccgtaatcagtcccatcgccttaaatgtataacgggccgacagggattttaccgcctccagctcaatcgggctgcccagttccttcacattttcaggctttttgaatgtccggccgttttcccccgcttttgtgacgatatctttaaagagtctgaccgggtattggctgccgcctttcagataatgggttttatccgttttgtcatagcccatccagacggctcctgtcagtccgggagtgtatcccgcaaaccaggcgtcctttgtcgcgccggggatgccggtaaatgtggtcgtgccggttttccccgccaggtcaccttgatagctgccttgtgaagcggttccttcttttacgacctgctgaagcattctcgtcatattccatgccgtctgtccgctgaagacgcgcgttttgccgtttttaggcccggataacgtttctccgtcttcgtccgtgatgttctctataaaaaatggcttcgtatacattccgtttgccgcaaaggtatgataagctccggcaagctgaagcggagtgacgccttcagacagaccgcccagcgcaatcgcgagtccgttgtcagaaatgttcatgccgtttttctcaagatacgattttcccatatccacgccgatctgcttcaatgtccagacagcgggcgcatttatgctgtaagtgatcgcatcctgcatcgtcacttcccccttgtactgtccgtcataatttttcggttcatacccgtcgtaggacgtcagtttgtcttggagaagcgaatacggtttgaacttgtcttcctgcatggcgggcccgtatacggcaatcggcttaaacgttgagcccggctgccgcttcgccgtaaccctgttgtatccttttgtcacgtagtcgcgcccgccgaccgccgcgcgcacgcctccggttttattatcaataaagacggcgcttccctctgccgcctgatccgtccccggaaaatagccgctttccttcatgagggtatatgccgttttctgcagcttggaatcaagtgacgtccggatcgtataaccgccttgaagcagctgttctcctgacatcgaataacggtcttccgcctccttgatgacaagatcgatataactgtcaaaccaaggcgtttctgatgttttcttgacattaagccccaatgtccggccctgggctctgacggcttccttggcgctgatatagccttgatcgttcatcattgcaagaatcgtatcgcgccgttctttatttttatccggatgctgaatcggcgaataaagagatggcgccttcggaatcgctgccagaacggctccttctgcaacggttaaatcttttacttctttattaaagtagtagtgggacgcggcttgaatgccgtaaacgccatggccgaaataaagctggttcaggtacatttcaagcagcttgtccttgctgtaatcacgctcaagattgatggcgataatgacttccttcgtcttgcgcaaaaatgttttatcatgagtcagaaaaatgtttttcgccagctgctgggtgatcgtgcttccgccctccaccttgccgcctgctaaaacatcccggaacaccgcccgtccgacagacttcacatcaatgccgtgatgttcgtaaaaccgtttatcttcaacggcgataaaggcatctctcacatcttccggaacctgctgaatggataccggctcacgattttccgtatagaggctcgcgatttcatcaccgttttgatcgacgatttttgaagatgcgtgcagtattaatttcttttcatcgatgacataatggccgagaaatataatgataatgtatccgattaacgcgagaaaagcggttgccgccgcaattacagccggaataaagaatctttttttctttttcagcataagtcacctcgcctttcttaacttgtagtatgggaaatattgtttcgaattatgtcagaatgagtcgccaatagaaacttataccactcttttgatatactagcaagcaggaggtggctgatatgaaggtttatattacatacgggacagccgattttttaaagacgattgccaagaaacacccgagtgagaatatggtgctgatgcaaggggaggataatgcggttttaattcatgaaacaaatggagaaaccgtttttcaggcgccccattcctatgaaagcatcgacagcgtcggggaaatcaaaaatccgggctacgccgtcctcaacaacatcgccgttacccaggaaggccgtccgctgtttgaaaaccggtttaaaaaccgcgccggcaaagtggaaaatgaacccggttttaaagccatccgcgtattaagaccgctcgaaggcgatacgtatgtcattttgaccctgtgggaagaggaaaaagcctttcaggattggcagcagtcaaactcttatcaggaagctcataaaaaacgcggaacatctgccggtatcgacacgacgtctattttttcccgtccgtcttatgtaaccgcttattacgcaatagactgaaaaccgccggagattctccggcttttttgatgtcccgattttacgcatccttctttgcaccttccgcccgcctatgaataccctgtagcaatcctatttataaacggagtggttcaattggggatcggcgtctactcggtacatctgctttatgttgcttttatcgcggccattatcgtttttatgcttctcagaaaagatacaacctttatttcactcgccggcatttttgtgattgcgctatggacgacgcattcattctccgcttcggtcagcagcctgtttcacagctttacgtatgccgccggagaattgctgccgacgatttttatcatttgttttatcgtggcgatgagcggccttttgaccaaaaccggtattaatgaagcgatgatttctccgtttgcaaagctgatgaaagggccggctgtcgcgtattgggttatcggctgtctgatgtttgccatctctctttttttctggccgtcacccggggtggcgctgatcggcgctgtgctgcttcccgcagcgatccgggcgggcctttctccgatcgctgcggctatggcgatgaacctgttcggccacggattcgctttatcgggggattacgtcattcaggcggccccgaaattaacggccgatgccgcgggcatcccagtgagcgatgtcatgcaggcaagtattccgctcgttttgatcatggggttaacgacgacaatcaccgctttcttcctcatcatgcgggatcgaaaaaaaacgaaggcccccctctccttggacagctccggttctttggacacaagtatgtatctgccgaaaaaactcagggtgatcctggcggttttcattccgcttgtttttctcgccgatattatctgcatgatcgtataccgcctccaaggaaacgatgcgacggcactcgtcggaggaaccgcgatcggcattctcctgatcattcatttcattgtatataaagagcggcatttagaaaagatcaccgagtattttatcggcggttttcaattcggctttaaagtattcggccccgtcattccgatcgcggccttcttttatctcggtgacgcggggtttaaaaatattttgaacaccccgctgccgaaagggtctgcgggaatcgtcaatgacctcggactggccctgtcccattcttttccgatgtccggagaattcgccggcatcgccctggccgcagtcggtgcgattaccgggctcgacgggtcagggttttccggtatatctcttgcaggctcgatggcaaagctgttttctgccgcgcttcatacggacccggccgttttaacggcgctgggccagatttcagcgatctgggtcgggggcggaacattggtcccttgggcactgattcccgctgcggctatttgtaaagttgacccgtttgagcttgccaggaaaaactttatccctgttgcggccggacttatcgtcacgaccatcgccgccatcatcattctcccgtagcaaaaagattgaaatcttctgacattttctatacaatcatgggaaaagcagacgagggggcatcgcttttgacgttaacgacacttcaaaaaagcttaaacgctcagcttgacgggctgtatgaggaaatggttgaaatcaggcgtcaccttcacatgaatcccgagccatcctttaaggagaaaaaaacaccggcgttcatcgcctcattttatgaaaagctcggcgtccccatccggacgaatgtcgggggcaacggtgtcacagcctgtattgaaggcggtgaaccgggaccggtcgtggcactcagagctgattttgacgctttgccgatacaggatgaaaaagatgtgccctatgcttcacaaattcccggcgtcatgcacgcctgcgggcatgacggccatacggcggctctgctcgcggccggaaaagtgctgtaccgcaaccgggaaaaactgaaagggtcatttgtgatgatccaccagcacgctgaggaattatctcccggcggagcaaaagcaatgattgaggacggctgcctcgaacatgtcgatgccattttcggcacacacctatgggcgactgaacccgtcggaacggtcttatgccgcccgggcccagtaatggccgccgctgacggctttacgattaaagtcatcggcaaaggcggtcacggtgcgatccctcacgatacgaaggacgccgttttaatcggctcacaaatcgtcacggctcttcagcatatcgtcagccggcgggtaaatccggtgcagccggccgtcatctcagcaggctcgttcaccgctgaaaatccgtttaatgcgattgccgatcaggcagtcatttcaggcaccgtccgctcgtttgacgaaagtgtgcgcggcctgctcgaagcagaaatagaagccgtcgtaaaaggaatctgttccatgcactccgcttcctatgaatatcgtttcaaacgcggctatcccgccgtcgtcaatcatcctgaggaagcggcgcacgcggcggcagccgcagcggaaacagacggcgttacgaaagtcgttgaaggagagccgcagatggcgggagaggatttttcctattatctgcagcatacaaaaggcgcttttttctttacgggcgccgctttagaaaatgcggaaaccgtttatcctcatcaccacccgaaatttgattttaatgaaaaagcgatgctgacggccgccaaggtgcttatcggcgccgcggtaagctacccccgctgacataaaaaaaacagccggtacattacgtaccggctgttgtaattcttaaatgaaaaacgtgccttgccgtctcaccgagctgtgacagcagtttataattggccgctccgcccacggcggctccgacgaccggcaaaagctgaaacaatttgaccacgtccagataatcgcggtattcctgctgaaaaactctccaatcgacatcatgctttttcgaatcccactgttcaatcattgagtatatgcgtttccgctgttcaccgcttgagaaagccagctgaaaaataaacagcaaaaacaatcgctcatccctgtctttcacatcatagccgtaaatggaggcaagatcgaacagacatttcattttaatggatagcagcaaaggaaaatcagccattcctaaaaaaattccgccggcccccgtaccgataccttcagctgccgcgaccttttggtacgatgcgatggtttgtctggcgagagcatctttttcagcaagcgtcataccgtttgtatcccgcttgcttttcaccagatttgaacccgccattgttgcttcggtcatttttttaatgctttctgtgatgacggcatgaattttttcgggaatccgctcatttattttcgcctgcattcctttagaaaagcgttcaagcatggaatctttgcgcaaaaaacgcgctttccattgcagtgcttcctgtaccagctgctgatcgtcggtcatctgtgtctccttctttcattgaggtttcaaaaacccgattgattacagcttgccgtactttttcaatcttccgcccatatacgatggcatgatcacaaaaatcagaacggctgaagcaacggccgcatacagcaccccgctgactcccgcggcataggctgacgctgcgcagaacagcagcgcctgcacggttaatgacgatttcatcagcgaaaagaaactttgcagcttcgctttctgattgaccgggtaaagctcctgcagagaaagatgatgaaaatgcccgaacagcggaagaagctgtattcccgtaataaagacggtaaatacggttaacgccgccgtgatccacggattggcggaaacgagcataataatcaggataaaaataatcgtgagcctgacctgaatgccgagataatcatttgaacgcagaaaggcccgcgcatacatataggagaacgttttccgctgctcaaacggaatcattctgagcaaaaagtcgagatacgcccggcgttttgcctgttttttcaggtgaggcacatcggtaaacagattggcgattctgtaaaaccgctgcttccttcttaattcatattcaatatgagcttcccattttaatgatttatgttttgcggctgatgtgaaatacacataaaggccggccatcacaatgtagacggcggcagcgtacacataaaacgactgtaagacgaagtataaaagcagcatattgcagataaagcgtatgaccgcatccatcattttcatgcttctgtcattcataaacgtcatccgccactccatggcctgattccacgcttttaccgccagcatctgaataaatacggcggcatacgacgcaagcgacgcccccggacttacagcgaaaaacagaggcatgcatacaagagacagagcaataagcggaaacagctgtgacagatagctgtacttaaatgaatgcttaaagtatgtccccattttcggttcaagcggcagcagaaacacgaggtccgcttcctttaacagcgtccggacgtatgaaccggtcagcacaaatgaaaagagcaccgccatcacccaaaaagagggaaaatgaacggggatgtctttgacccacttgctgtaccagctcgccgcgccggcaataaaaaagatcagcacaatgacgagatgatcattgagcatatatttcatatacattctggtttcctttatatgctcttcaagccgggactgccaaatagtagacatattattcatggccggcgtcttccttcgtcagttcaatatacaagtcatcaagagctgcgtctttcatgccgaactgctctctcagttcttccagtgtgccgcttgcccgcacttcgccgttatgtaaaataatgaatgcgtcacagtagcgctctgccgtagccaggatatgcgttgacatcagcacgcttgatccggcttttttcgcggcgtccatccgctccagcaatgcattgatcgcaagcgggtcaaggccgagaaacggctcgtcaatgatataaagcgagggctccgcgagaaacgcgcacatgatcatgaccttctgcttcatccctttggaaaagtgagcgggaaaccatttcagccttttttccattctgaattctttcaaaagcggaggaagccttttttcaagcgtttctttggaaaggccgtacgccatggccgtcagctccagatgctctttgagcgtcagttcttcatacagcaccggcgtttcggggatgtacgtaaattgcgagcggtagctttccttatcctccgaaaacgtcttgccgttcagctcgatcgagcctttatgcgggtccattaatccgataatatgccggatcgtcgtgcttttgcccgcgccgtttaatccgatgagtccgacaatctggttcggctcaagggtgaatgaaacattttttaagaccgggtttctcgtataaccgccggttaagtcttttaccgatagcagagacataatttctccccttctgattcgtttttcttcatagtaccaaaaataaagtctgatttgaaacgattccctttttttctcacgtgaaaagcgtgcatagttatcgttttggcggacatcataatgtatgtagaaggaaacagctttaatcaactgaaaatgaggtgtttataaaagacgtcttagaacagttggatgaaaatcaacatgtcctgtgcttacaatttcttcacacactgctttgatgatgttcttcattcatgatgaaataatcaaatgaggtgtttgtcccaggaatgattaagcagacccataagtcttcattttaaaaacaaatgaggtgcttacaaaaggcatatttaattttctgtgataaagctcgtacttctgcatcagggtgaacgcgcagccgttcatcctgttttttgttttgaccgtttttgtggtacgatgagaatatacatatatttcttttcagggaggaaacccatctatgcacaaagcggacgattgtattttctgcaaaatcattgccggtgacattccgtcttcaaaagtatacgaaaatgaacatgttgtggcgtttcttgatatcagccaagtcacaaaaggccatacgctcgtgattccgaaaacacatatcgaaaacgtgtacgagtttacgcctgagctttctaaagaatatttcgaagcggtgccgaaagtcgcacgcgccatccgcgatgaattcgagccgatcgggctgaatattctcaataataacggtgaaaaagcgggccaatcggtgttccattttcacatgcatatcattccgcgttacggaaaaggcgacggtttcggggctgtctggaagacccacgccgaagactatacgcctgacgatcttcaggagatcgcttcaaccgtcagaaaacggcttgcctcatcttaaagatgaggtttttttgcgtccggcaacacaaaaaacataaaattatattttttcatatcaaaaaaatcaaaaaattgtgataggataattgtattatttcttacactaaagcggaaaacagggagagatcgtaaacatggaacgtacaacgaatttcaatgcaggacccgcagcccttccactggatgtgctgcaaaaagcacagaaagaatttgtcaacttcaatgacaccggcatgtccgtcatggagctgtcccaccgaagcaaagaatatgatgcggtgcatcaaaaagcaaaaagccttctgaaagaactgatggatattcccgacgattatgatattttatttcttcaaggcggcgcaagccttcaattctccatgctgccgatgaactttttaacgccggagcaaacggctcacttcatcgtaacgggcgcatggtctgaaaaagcactcgccgaggcgaaactgttcggaaacacatccgtcacggcaacaagcgcagattcaaaccacaaccatataccggaagcggacctcacaggaatcaaagacggcgcctacctgcatcttacgtccaataacacgattttcggaacgcagtggaaagagttcccgaattcaccaatcccgctcgtagccgacatgtcaagcgacatcctgagcagaaaaattgatgtcaaaacgtttgatgtcatctatggcggcgcccagaaaaacctcggtccgtccggcgtcacggtcgtcatcatgaaaaaatcatggcttgaaaacgaaaacgccaacgtccctaaaattttgaaatactccactcatacaaaagccgattcactgtataatacgccgcctacatttgcgatttatatgctgagcctcgtccttgaatggctggctgaaaacggaggtgtcgaagcggctgaacggcgcaatcatgaaaaggccgacgtcctgtacggcacaatcgacgcaagcggcggtttttacgcggggcatgccgcaaaagacagccgttctcacatgaacgtcacgttcaccctccgcgacagcagtctcacgaaaaaattcgttgaagaagcgaaagcggctaaaatgaccggactcggaggccaccgctcagtcggaggatgcagggcgtctatctacaacgccgtcagcctggctgattgtgaaaaactggctcagtttatgaaaaagttccagcaggaaaacgaataaatttcttctaacataacggttcctttgatatactgtttgcatatcaatttttccggccatcgcaataaatgacgagcatattattggatggcgaaaaagcttagcagaggagagcttagtatgaaaacaaaagaattagtcattatggccctgtttgcggcaatcggagcggtgcttcattccattatgccgccggtattattcggaatgaaacccgatatgatgcttgtgatgatgtttatgggtattctgttatttccccgtgtgcagaacgtgctgatgatcgggattgtaacgggaatcatttccgcactcacgacatcttttccgggcggacagcttccgaatatcattgaaaaaccggtaacggcgtttctgtttctcgcgctggcgcttttggtgaaaaagagcgtgaaaacagcggccgccgccgtcattacaatagccggcaccttcatctccggtttgctctttctggcgctggcccttctgattgtcggcctgccggggggattcaccgccttggtgctcgcggtcgtccttccggcggctgcgctgaatgcgatcgccattatcattatgcatccgattgtgcagacgatcttaaaacggtccaatatgattgaaacggtgaaataaccgcataccgaaacctcttccggccggaagaggttttttaatgtgtttcagcatgttttatacgagaagttttgtgaaaaagataaggaacaatgcgagggcggttcctgctgagcagacgatggccttttggcggacgacccgcttcggcggataagaagcggcctggccgagcagtttcaggtaataaacggcgcccgccgcaaagacaagagccatacaagataaaacaatcataaagacagacaaccttctccctccttttcccttaaaaaatatgctaaaataaagcaagctatgtatagaagtttattcttctgaacaaaaatgataaaagttatgagaaaaaaaacggggtgattttaaatggctgacggacgttcccttttaacaggccttttcgtaggcggattgatcggaggcgcagcggtgttactttcggctccttcatccggaaaagagctgcggggcaaaatcaaagcgaattgcaattcaattgaggacacaatcaaacggttaaaaaaagacggaatggcgcttaaagaccagcttgtccaaacggcgaaagaaagcgcagaagtcattaaagacgtaggcggagagcttcagaccagcattaaaaggtggcaggaggaaatcaagccgcaccagcaggatcttcaaaaggaaatcgctgatattgaagagaaaatcagacagctggagaaaaccttacaaaactaatatcctatacaaccaaaaaaagtgcgggcatattgcgttccgcacttttttttgcggtttaaagcctttcacagcaacggattaagaatttattataaaattcttaaattttcatctttattaatctttattttattggcataatagaggaaaagaaaatgtgaagcaggtgatctgtattgaatcgtgttgaaccgccttacgatctaaaagaagctttaatctatacccaaaaaatggcgcagctgtccaaagcactctggaaatctatcgagaaagactggcagaattggctgaagccgtacgaccttaatattaatgagcatcatatattatggattgcctatcagcttaaaggagcttctatttcagaaatcgccaaattcggcgttatgcacgtatcaactgcatttaacttttcaaaaaagcttgaagaacggggatatctgaaattttccaagcggctgaatgataaacggaacacgtacattcagttaacagaagaaggggaaaatgtattcgaaagcctgcttgaggagtttgacccgtctagaaacgcggtgtttaaaggctcacagccgatctaccacttattcgggaagtttccggaagttgaagaattaacctgtgtcatccgccacatttacggcgaagattttatggagatattcgagaaatcattgacaaacataaacaatgattttgatagtgaagacggaaggctgaagaaaaaaacagacgaatcggctgtccatgaaacggctgaagagctggaaccgatcaacagttaatcaaagtgcttcattatctcaataaattcttccatcagcgctgtataaagcccctgctcatacagagcaaaaatcgtttcatgaacatctaatttttcgttcagctgtcccgcaaaaagcgcaaggagcttgtcaaacgtcacaaagccttgcgctttttgcgactccagctcgtcctccaattcgcggcagatccgcccgacctcttctccttcttcttcggtcagccctttttcaatcatcatcgcataaaaagggtacttatccatatccaccgttttcaccagcaattgtatgtaatattctaaacgcccgatacgctgatccattgaatccatccgtttcacttctttctatctttaatcttattttagctgataatgaatggagaagaaaggttaaaccgtacatttccatgtttcaccgagctcttctgttcttccctttccggggttattttttttctttaaaaaaggattgattttttctcctgaagagagtaaattattttgagattgtattccatctttgtacggaaggatgactctgatgaattgctggaaaaccattaatctgatcaaagattatggtgcggttcgtttattattgactgctgtaggttttatgatcctgttttttatatgcaacttcttggcattcgggctgctgcgtccgaatatcagtttaagtgacgggcacgtgtttgctttttgtgttctgctcgttgttactttatttgtacataaagtcatacatgtcctgccgatgatctgtaaaaaaagaaaaaaggaaatgaaaatgtacttcttgcggatgccgacatggaaaggcataccgaaaacgacgatgctgatttctacgatcagcccgtttttattcattacgccgctattgttttatgccggactggcatttccgagacacgctcattacttttatatgatttcgagcattcatgcgggttattgcctgcctgatcttctgtttgcgctgcacctggtcaaagcgcccaaatcatgtctgattgaccaggaatccgacggttttgatattttagtaaaaaaagtgccggagtcttgatatcccgctgatttttcaggttacattctatcttttttaataaatatttggtaatgtaatatgggagcagttcagagagagggggaatctcccatcattttattctattttatcgtggctgccctgtttattctttattttataaacaggctcacaaatacattatgccttgtcagagagattcctgaagaccggcaggataaggtattccgttttattaatgtatctattttaattttactgatctcttcattcgtcgagatctcctttactgtgtaaacaggcaaaaaaatatggctgacggaggtctgacccccgacagccatatttttttcttaataaagccaagaagcgccgatgatgatcaataagatgaacagaacaaccaataatgcaaaaccgcctgcaaatacttcacccatctccaaaagcacctcctacaaaacgttttatttttccaattacatcatatgcaatttacttctgaaacgattaggcgcccgggtaagaaaacggatcgcttttagaaaaagcgatccgtttcgcttaacaaatgtaagctgcacctacgatgataagcaatatgaacagtactacgagcagtgcgaaaccgtttgaatatcctccgcccatggttcattacctccttttcatgatcaatatatttgtatgtatcaggaaaaagtttgactagacgaatgccctttatttaaaatctttttacagaaagccacaatatgttatgatacgcatatgcaatttaatttggatgattaggagtgtttaaaggaatgaagaaaatcgcgatagcagctattacggcaacgagcgtcctggctctcagcgcttgcagcagcggcgacaacgacgtgattgccaagacggatgccggaaatgtaacaaaaggcgaactctacacgaatatgaaaaaaaccgcgggcgcaagtgtgctgacacagctcgtacaagaaaaagtattagcaaaaaaatacaaagtatcggataaagaaatcgataacaagctgaaagagtacaaaacgcagctcggcgatcagtacagcgcccttaaacagcagtacggcgaagattacctgaaagatcaggtgaagtacgaactgcttgcacaaaaagcggcgaaagacaacatcaaagtgactgacgctgatacgaaagaatattacgacggcttaaaaggtaaaatccgggcgagccacattcttgtcgctgacaaaaagacagctgacgaagtggagaaaaaactgaaaaaaggcgagaagtttgaaacgcttgcgaaagaatattcaactgacaactcaaaagacaacggcggcgaccttggctggttcgataaaaagtcaatggatgaaacattcagcaaagctgcattcggtctgaaagtcggacaagtcagcgatccggtcaaaacaaaattcggttatcatatcatcaaaaagacagaggaacgcggcaaatatgatgacatgaaaaaagagttgaaagaagaagttcttaaacagaaattaaacgacaactcagctgtacaggcggcaattcaaaaagtcatgaaaaaagctgacgtaaaagtggaagacaaagacttaaaagacacgtttaacacttcaacttcttctgaatctaaataaaaaaaactgtgcgggctctcagcgagccccgcacagtttttttatgcgatggaatgattggagttttcttctgcatccgtgttttcacttgcgggcgccgccatacggcgctcgcgttcctgttccatccgttcaatatacacccttccttctttttcaataaacgactggtcaagcttttcctcttctttagctgttgtgaaaagcttataggcgctgaaaataattccgataatgcaaaggtatacccaccaaggaaaaaatagcacgtcggtttcctccctttttcacccagagtctttattctaagctatgcttgataaagacaagttatgagagctgaacgtaaaaaagaccgatcatagagaatcggcctttttatcttattgatggaacgtcggtttgtagaaagaacggttttccagcgcaaatacacgctctgtgtattcgcccggcttcacccgttccagcgctctgtccatcatgatcatttttgcatccagattgtcaatgtagtgcagaatttccgcttctttcaccatcggcggtttcgggcttccccattccgcttttccgtgatggcttaaaatcaaatgcttcagaatcagcacttcttcagcgtcaatctgaagctcttcggctgcttttgaaagctctgtcaccatgatcgaaatgtgcccgagcagattcccttccacggtgtacgtcgtggagacggggcctgaaagctcttttactttgccgagatcatgcagaatgactccggcatacagtaaatcccggtcaagagacggatacagatcggcaatcgcttttgccaggttcagcatggacactacatgatacgcgagcccggagacgaactcatggtggtttttagccgccgccgggtaatccataaactcagccgcatattttttgaccagatgtcttgtgatccgctggatatttggatttttcatttcaaaaatgtattgagtgacggtttccatcatttcatttttcggaatcggcgccgtttccagaaaatcatcaatgctgacattttcgttctcgccggccggccggatgtttctcagcttaagctggtttcgtccgcgatagtgatggacatctccgatcaccttcacgatcgtctgcgccgcgtacgttacttcatcagtcggcttggcatcccacagcttcgcttcgatatctcccgattggtcctgcagcattaacgtcaggaatggttttccgttgcttgcgattcccttagtcgaagatttaatcagaaagtattgatcgacctgctcgccgacctcgtgcagcataataccttttgccattctattaaaagctccctccatatcttacataataccagtatagcacatacctcttttttgaaaataaactcttttatgacaggagccgcatgacttgtccgctgtgaaaagaccggctgacatgctcatggcaggtgaaataaagtatctgccgcccgccttctgaaagctgattcagcacatcaaacagccgctccagccgctgcctgtcaaaatggacaaaactgtcatcaagtaaaaacggaagtgataccgcagattccctctctgacgcaagggcaaaacggatcgccgcataaagctgctcgcatgccgcctgtgacagttcgcctgctgaaaacacagttccgtctttccgcatgaccataatggaatcatccgcctcggagaaatacaatttatggtaacgtccgtccgtaagcggtccgtataatgcaccggcggtttctaacagacggggaagcgtcacttttttatgccgctccattttttccctgatgatgtgtctgaccgtctgtaatgcggcccactctttagcggtttttttcacgcgctccttctgcatttctgtctgctgttttaaatcggatacaagccccgaggactccagctgctcttgtttcaccgttaataaagcggttttctcacggagctgcgcgcttttttcctcaagcgtttttttctctgtttccttctgaacgactgtatgttcaagttcggacactgtgcggctcatatacggctcaagctgttttccgcctatgccggacaagtgcgttttgatttcgcgcagctgccgctctgtttcccggcggctttcattcagtctggcgagttcacaaaagtgttcgcgattttttgcgcctgccgccatgaaaagctgtttgacctgctgttcgtagtaatggacttcttcgtttaattcacgcatttgctcttgtgcatgcagcagatccgtttcgagcgcctgctttcgttttgcttcctcacgggcccgttccgcctgtaccagcaaaacgcgcagtctttcttttacggacagctcccttccgtctgaaggactcagctttttgacccggtcctcaaatgctctttgcaacttttgcagccggcccgcttcaatggtcagctcatgcttattaaggatttcttttttgacatctttcatcacatgatatgcgtcaagaagatgggaaggacttcctgaaaaacccagttccttcataaaaagttccgcctgtttttcagacggcgccatttccgcctcccattcttcatattggcggatgactctttcatatgccgcttctttctgttcaagcacggcttgatccgcaatcagctgctgccggtgccggccgtcacgccaaagctcttcctgcagaaggtcagccgcttctttggagatcgtcggcttctttttcttgtgaccggcccctcctctttctgacggcagcggtttttgcatgccggacagcatatacagcagcagagcgccggtaaaaagggcggcgggcagccattcctttaacatagcgaaaatcgcaatgaacagaatgcccgcaccgagaaagagctttttttgtttggcgcgctgtttttccagctgctgtacatgtgcctgccattcgtttccttctgtatcagccgtttgcttatatgattgtaaagcggcttctttttctttcctgacagcggggtccaaaatgttttccgacgtcaaggcatgttttcgttcggcttcttccagctccagccgcgcttgttcgaaaatcgcatcaagctgtgtctttctttctcttgcctgtccggcgctctgcacggcttcctgcagccgccattcatattcataatcggtgttcagtgaaagaatgccgtcttcctcatgtcttccgagctgctgcaatcctgacaaaacgcgggcagatgtctgccggatctgtgattggatggcggcaagctgttcaccgcgcgattcgtacatatgctgctcgccggaaagctcctgcagctgccgctctgtttgcagcaagtcctcatttggagcgagcagctcagcctgccgcctgagttcagcagcttttgcccgaagtccctcaagacgggcagctttcggatggagatgcgattcgtatttttcaagctgatgcatcccgtccttcgggaattgcttcaatgcatccggataagaagaaagttcgctttccaaggctgtttttttgtctgcgagcggctttgcttctatcgccgattttactgttttgatttcttcagttatgtctttcaatcgtgcttcggcatcctgcaaacggccgccggcgctttttttctcttccagaaggctgtgatagcccgcttccgcagcttccgcctgtttcagctgggcgctgagccgctttaatgtatccaactcctgatttaagcgggggttccgcccgttcggcttatacatcctttcaagttcttttgccagccgcccgtcaagctttgccgccgcttccgacccgaataagctcgaatacaggagaaactcgccgattttgtcccggttaaaagcttgaatctcctgcagtccgaatacatcgaacgaatagatcgcttcgtacagcgcccggtctgtatcggagagaagctgtttgagccattctccgtccttgatttcgcctgaagccgtatacactctgactttttcggcagcgccttttgtccgttcgattttgacggcaccgtgatcgccatgcttcaattccacagtgccgccgtaaaccccgccgtttttcggttcgtatttttttgatttcggaaaaccgaacagcacgcttttgatgaaggacatcaatgttgttttacccgcttcatttaatccgtagatcacttgcacgggagaatctgacagctgaaaactttggtcggaaaattttccgtattggtaaatatgcattgccgttattttcatcgctgaagctccttcatctggcgtcttaaaacggcttgagcctgccgcttaatatccagtatctcttcatctgtaaatgaagtgatctgacgccgatatacgggatgacgctcaagggcttcaaatacaccgctcatgtccgcgcattgttctatgtcctgaagcagccctttaaaaaacggatcgggcggcacgctgtctgtttcatccgtccgatcctcaagcgcaagcggccagacgaaacattcctcttcggcctcttcctcctgtaaagcggaaagaaactcctctgcgatgcctgcgggcgcctccgtccaaaagcggggcgccgcgccgcgaagcaccagcctgacacatgccgggcggcccgccgcgcgcaagccggagaatgtatccgatgcggctttcagaagtgaagtcatatgttcagctcctgagatatcaagatcaatttcctcccataacacatcatgcgcttctttgaattcccaagacatctcaccgtttgccgcccggacgagataatatcccttaggcccggtttcttttaaatgccgggcttgaatattcccggggtaaatagcggcgggatgctgggcggacagaacctgccgtttatgaatgtgtccgagcgcccagtaatccatgccgcttttttcaaggtcttctttcgtaaacgggcagtacgggtcatgcccttccgctcctgataacatgccgtggagcatgccgatatgataaggcgcgccggtcattttccggtaacgggccgcctgattgaccgttacgcttctttcctgatagctgcatccgtatatgcttgccgcaagctctccgtttttaaagaaagatttttcctccggtgtacccgaggtgaatatatgtacattttccggccattcaatcggcgtccacttaccgcccaaatgatcatggttgccgaatatgacgaacacttggatacccgcttcctgtaatctcgtaaactgttttctcaaaaacagctgggcttttaaacttctgttggcttcgtcaaacagatcccccgaaagcagcacgaaatctgcctgctcccggagtgccccgtccgtcagacggcggacgctgtgaaatgtgctttctttaatacgcgcatataccggttcaggcagattcgaaatgccgtaaaacgggctgtccagatgcaggtcagcggcatgaataaacgtcagatcagccatctcgccctcccctttctgcagattgaattacccttattttagcaccgtttttatacgaatgcacgttctgtaaaataaaaaaacagcccggctgttccgggctgtttcatttattttttggagatgcgcagcgcttgtttgatcgctttgaatccgctggcgtttccgtaaatcaaaacgccgcctttgtaaattttcgcgccgaccgccgcaaagatcacgatagtgaccagtgtcagggcgatcccggccgcagcctgccaaaacgggatatcgagcatcccgacgcgtaaaaacataatcatcggcgtgaaaaacggaatgtaagatgtaacggtaataaaaccggcgtcaggattgccgatgccgaacatggcgatcataaaacctgccacgaccaaaaaaaccatcggctgaatcgtctgctgtacgtcctctatccggctgacaacactgccgagaaacgcggcaagcgtcgcgtaaagaaaatagccgagcaaatagaaaatgacggcatagactatcgtcgagacgggaacatccgtaaaattgaggaatgcactgatcggcgacgacgcatcattttgagggttcagcttcagtgagagataacccgctgcaatcagcaccgcaaactgtgtgatccccacgagcgcgataccgaacagtttggcaaacatctgctgaatcggcggcatgcttgaaattaaaatttccatgacgcgggacgatttttccgtcgccacttccatcgcaatcatgcttgcgtacatgataactgagaagtagatgacaaacagcatgatgtatacaagccccattacctgaccgagctcttcctcagatttcgcccctttttccagcgcgtctttgctgacttccggcggagtgtagaggctgctgactttttctgccgaaatgccgagcttggcggtttcgacagcggttttcgtctgggttaaagcctgcttgagcagtttatacgctgattcatcagaaatggtcagcgccttgtatgctcccgttatcgttcctttttgatcctgtctgatgataaacagtccgtcccattcaccgtctttgacacgctttacggcatctttttcggactccttcgtctccattgcctgcagatcattgtctgtatccgccgctttaagctgttttgcaaacgccgggtacagcccgcccgtttcatcaatcaccgcgatttgctgcttgccgtcatccgattgaaacacggaaataatcgattgcaggttggtcaccgctaatactaataaaacggtaatggcggtcgaaataatgaatgactttgttgcgattttgtttttatatgtatgaaacagcataatccaaaatttattcatatacggcccccaccttttctataaaaatatcatgcagtgacggctcttccaattcgaacttccgtataaaacctttcccttgcagcgcccggaaaatatcctgcgaaaccggttcattcgcgacctgcagtctgattccgtcatttgtttccttccatttcacgacaccttcatgcgtttttaaaaagctgaggtcatcatctgaatgaacggtgacattttttttgccgaaagaccgcttaatgtctttcagattgccttgaacgacgggttttcccttctggagaatgcacaaattctcgcaaagttcttccacatgctccattcggtggcttgaaaaaacgatggaaacgccgctgtttttcaaagaaataaccgcttctttcagcagctcgacattcaccggatcaagaccgctgaaaggttcatcgagaatcagcagttcaggcttatgcaggacggccgaaatgaactggattttctgctggtttccttttgacagctcttcgactttcttattcttgtaatctgtaatgccgaagcgttcgagccatgtcatgagctctttttccgcctcttttttgctcattccttttaatctcgccagatagacaagctggtcactcaccttcactttcggatacagcccccgttcttccgggagatagccgattttttcactgatggaataattgaccggcttccctttccaggtgatatgcccgtcagtcaggcttaaaagacctaaaatcatccgaaaggtcgtcgtttttcccgcgccgtttgcgccgagcagcccgaacatttccctttcaggtatttgcaggttcaaattgtcaacagcggtaaagctgccgaatgttttcgttacattttcaattgtaagcacgaatccaactccttccttgacccattatatactaataatgggtaaaaattaatggaggattttaaattctttatcagaatatcattctataaagggggtgacatgatgggacaatatgtattgaccgcattccatgcgtcgggagaaacgctgctggatgaacggatcgaagcagataatgaggcggaggcgaaggccgccggagaggctttgttagaggaaaaaaagcttgagaacagtactcaccgcttggtaaatgaagccggaaagctgattttattccacagataacagaagctttccggcttctgtattttaccggttaaattgcggcgtccgtttttctaaaaaggcgcggatgccctctttatgatcatccgtttttctcatattttcctgggcctttcgttcaagagataaaacgtcttttaaccggctgatatggaggctctgataaatagccttcgtttcaatcatcgctgacagcggcgcatgcagcaatcggtcgatatacggttgtgccccctccgcagggccgccgctgaacagcccgtcggcaagcttgagccgcaccgctttttcagccggcaatttttcaccgctccaaatcagttttttcgcttcgatctcaccgacgcgtctcattaataaataatggcctcctccgtcgggaaccaatccgatgccgatgaaattcatcgcgagtcgggcgttttcttcggcgagcaccacatcggcgcacagcgcgaaactcagcccgagccccgccgcggctccgtggatggcggctatcacaatttttttcatatcatagagcgtcagcgtaatggattcaatcattttcatgagccgttcatattctcccgaatcatgatccgacgtcatcatctggatatcaccgcccgcggaaaatccccggccttccccccgcaagaggacgataagcgcttcgctgtcggctgccataacgcatgcattttccaattcccggagcatttgttcattcagcgcgttgtaactgtcaggacggttcagcacaatctctgcgatctttcccttttcttcataacgaatatactgcatgtttactccctccttgaatccgcttacatattttgttcaaatgatatattccttcccccgaagcgaaactcctttatttttcaaggtcaacagataccgaaaaatgcatatcatttgaaactgaacatacatttttatatagtgaaattgatatacaaaacaaaaaggggggaaaaacaccgataatgaaatatgtgatactcagcttgttactgagcttttttatggtgctgttccccccttcggatgtcgctcttccttcccaattggtgacagaaacagacagccatgtacaaatttcggtctacccgcaggaaacggaatcggcaaagacgccggttcaaaccaaaaccgctccgcaaggcctgtcaaaaggatacggtgcgttatcccggatgatctccctgttatctgtcaaacctcttgatcaattcattgattccacaatggaaaggacatgcgccattccgatacaataccagtcaaattacctccggcatcagaccatttctcattgccaatctgtatttacggtgtaaaaacagtatattccggagggattttttatgaatattaaagaaaacgatctgcccggcatcgggaaaaaattcgaaatcgaaacgagaaatcatgaaaaaatgacgatcatcattcatgatgacggcaggcgggaaatttacagatttgatgaccgcgaccctgatgagcttctggcaagcatttcacttgatgatgcggaagcaagacagattgccgcgattatcggcgggatggtgtacaaaccgcaggcgcttgaatcgattgaaatggcgttcagcgatctgattatcgaatggtttaaagttgaaaaaggggcaaaagcggcagggcggacgctcggcgaactggatgtgcgccaaaactatgacgtgacggttatcgccatcataaagcatgaccagaaaaagtttttaaacccgggggctgattcgctccttgaagcaaacgatacactcgtcctctcaggtgaaagaaagcatctgaaaaaactgatccaagacttcctctccagagacggagtgtgatctgtttatggaccatctcgtatttgaagtcggtacggcgttagttcttgtggccattgcgagtgtcatcgccaataaaattaaattctcgatcatccccttcctgatcattttaggaatgcttgtcgggccgcacgcgccccaggcgggcatcattgatctgacgtttatcgaaagccgggaagtgattgaatttttcggacggatgggcgtcctgttcctcctcttttacctcgggcttgaattctcagtcggaaaattagtcaaatccggacgttcaatcgccgccggcggaacgatttatattctgattaatttcagtttagggctgatctacggatttatcacgggcttttcctttttggaagtgcttgtattggcgggcgtcatcacgatatcatccagcgccattgtcgcaaaggtgcttgtcgacttaaagcgcacggccaatccggaaacggagctgattctcggcatcattatgtttgaggatatctttctggcggtttacttatccgtcgtttccgggcttgttctgggagacgcgacgtctgtcgggggcgcgctgatgtcaatcgtgatcgctttcggatatatgctgctgtttttcattgccgcccggaaattgccgcctctgctgaacaagctgcttgatatccgttcaaacgaggtatttgtcatcgtcattttcgccgcgctctttttcattgccggcttttccgaaacgattcatgtcgctgaagcgatcggcgcgctcttgctcgggctcgtgttttcggagacggcccattctgacaggattgagcatcttgtcgtgccgttccgtgactttttcggcgccatgtttttcttcagtttcggcctcagcattgatccgttttcactcggagatgcggtatggctcgccctcggcgccgttctgctgacgattgccggaaactttatcgccggcatgatcgccgggcgccgggcggggctttctcataaagcatcgtccaatatcgggctgaccattgtgtcccgcggcgaattctccattatcgtcgcaaatctcggcatcgccggcggcctgtccgcttcacttaaacctttcgccgccttatatgttttgatactggccatcttcggccctttgctcacgaaagaatcgaagcggatatatctcctgctgaacagcgtattcaaatggaagacgcctgaaaagaagccgcagaaatcataaaaaaaaactgacctcttcataagaggtcagtttttttgagcgggaagaaattgctgaaaagccgtttttttattaatggagaaatgctcttttcccagaatggtattgatgattttttggtttctgtaaacagacagcttcaaattcgtagcgcccgttccgtgagcatgatcaagattcgttaatgtgaaaaaatgatgccgtctgtcgtccttaaagacaagacgggaatcggccgtcactttaaaccgtttctcatcctcccattcgatatcgggggcgattgccgtaaaccattccggaatatgaggtttaaagccggtcgccaatatcactttttctgaatcggccgtaaaagtttcatccatctgccattgatgaaagctcagtacacagcgcccgttttgcttttcaattttttcaagctccgccatcggctgaatatacacgtcaggcgaacctccgctgatcgatctgtgatacagggcgtcgtaaatggtggcaagtgtgtcagaatcaatgccgtggcgcagtccgtccagctcagggagtgtgttcagccgttctttaaaaggcaggcggttaaaatattccacataatcaggtgtaaacatttcctgcccgagcttggcggtttccaattctcgaaatccggcggagcgtgtcacccattgcagccggctgcgccggtattgttcatcatgcaataagtcagaaaagatctccgcggcgctctgtccggagccgaccactgtaattgattcggcgccggcgagctcgtctttccggaacaaatattccgtgctgaccatcgtgtcctgacgcgctccgtcatcaatctctgcgggaataagcggttcagaccccgtccccatgacgaaatgcttcgtctgatagacactgatgcttccgtcctcaatgttcttgacgctgacttcataatgtccgccggcatttttcacgccgattacctctgagccgaaacggcatgatttgatttctgaagccgcccagcttaaatagtcgttaaattcccgtctcggaatatcaaattcattaaacgtataaaaccggtacagccggtcatgttcatggagaaagtttaaaaacgtgtagcggcttttcggatcggcgagcgtgaccaggtccgccagaaacgccacctgtaaatccgttcctttaattaatagaccgggatgccacgcaaattctttctttttatcgaaaaaaagagcgtctgttccgggtatatcctctaacaatgcggcaagccctaaattaaacggcccgattcccgctcctatgacatcatacatattatgcacctcttgcgaataacagtctgatgatcttttcccgtttttacagacggttaaacataaaaaaacggcacgctgattccgtgccgtttttgatattataatgcagatttgacgaacatctcatctaagtatttgattttctcttctgtataatgctcgaatcggtcattatatgatttcgggtctttcggattggcgaagtgcgtgatttttccggtttccggatgaatgaatttgcttgccgccccgcagccgataccgataatcgtctgcacttcttccataatcataatgttgtagatgctttcctgacccgggaaggagtagccgacattttcaaggtttccgagaatatttttctgccgatacaagtagtacggcgtatagccgtgctcttttgtccagcggacggcgtcatccatcatgcgggacacttcctgtctgtcggcaactttatacttatgcttgtttctcgtcatttctgacgcccgtttaaaagaaagcgtatgaacggtcaaagattcaggcatcagcttttccgtttcttcaagactgtgcctgaactcagccgtcccttctcccggcaggccgatgatcaggtccatgttgatattattcatgccgtgtttgcgggaaagatggtatttttcgatggtttcttcaacggtatggtgtctgccgatagccttaagcgtttcgttttcataagattgcgggttgatgctgattctgtcaatcttatacttatttaaaacggcaagcttttcctccgtaatcgtgtcgggacggcccgcttcaacggtaatctccctgatattcgcgacatccgggaaagagcggaccatttcttcatataaaagatccatttcttcagcggtaatgcttgtcggcgtgccgccgccgaaataaatggtcgtcactttgatatcatgccgcttcagccattctccgattttctgcatttcatagtgaagcccccataaaaaggagccgactcttcccgcctgtccttgaatggcataagccggaaacgtgcagtaggcgcacttcgtcgggcagaacgggatgccgatataaatgctgacttcatctttgacccggtacagatcgggaaccgcagcgagctggcggtcgacaatctcctgcatcagattgattttttcatcatggatcagatagtcttttttcagatcggcatgcgcctcttcttttgtcaggccgctctgcagctttttatgaagaagtttagtaggcctgatgccggttaagattccccatttttgtgtcatgcccgtatgtgattgaagaagatttaagtagacatatgacagcgtgtttttcacctgtttaaatacttctttttcgctccatccggcaagaagcggtttcgtgtgatgttccttttcgccggttcctttgatttctccggataccgacacgctgtctgcatcttgagaaatggcaagtgagatgacgagatcagagggttcctccgtttcgccgtacgtaagaacacactcttcaaaaaataaattcgcgatgttttgcagcggacgatgcagcctgtcatccgttatgccgtctatttttatttgcaatgtgatcaccttatttttcagattcaaaactttctttagtgtacagaaagaacaggctaaaatcaatccgcgaaaaagccgcagaccggcgtttcgcgtctgcggctcttgattacggccgtttcatatggaacttatcgagaaagcctttgcggtgctgcatgcggaaatattccttaatcatataagccactccctgttcatcatttgaccttgtcacccagtccgcttttctttttaattcatttgaagcattccccatcgcgacgccgagaccggccagctcgatcatcggcagatcatcttcctgatggccgatagccacaacctcttccattgaaagcccgagatcagcggcgaccatcgaaagtccgctttcttttgaaacccctttaggcacgatgttcagtttttctccgttgacgcggatcacatcgacggccgggaatgctttcattatcgtatccgttatatcagcctgcaggccatcttcagcatgcacttcaatgacgggcgctgaaaccggctcatcaaggagcaggtcacttaatgattcgacaaactgcaccggataaaagatcgggtcagacggatgaatcatcgttttcccgaccagattggagttcactttcttcttgttaccgatcgaatatttttcgtgaagaagccggatattgcattgatagctttcgagcacctgaacgatattaaacgtgtgatcttctgatattttcttttcaaaaaacggctcatctattttttcagaaatgtatgcgccgctgtgggtaatcaattttgcattcagctttaatattttcgccactttttgagcggagcgaaaatggcggtttgtgaccagtgtgacgtaaatcccttttttcttgacgtattcgatggcatcctttgtcgtctgatgaagtttgccgttggagcgaagaagcgctccgtctatatttaacgccagcatttgttttgacacagagaagtccccctccttgatgactgtacttgtcattaggatatgaccctgtctctttgtttagaacaaccttttctccgcagcaaaaaagcctgcctcaagcagactttgaactgtcgttttgttgggatacgatcgatttgctgccttctccccaatgtgcatttctattaacgaaatatatcaggaaccccttatttgaccgttgatgcgctcgtttcacttactctctgttgctaccccttaacataccaggcagtataggcgaccgtatccttagatcatctgtaagtgtaggcgctttcagagttattatctcaataatattgttaaaaaacaagggtttttttaactaaaaaaatcaggggaactatctgtgctgaatgtatgataaaattgaaaaggaacgtatattcgcatataataaaagaaaaaaagcggtgactgtcatgtctctattaaaagatatttataacgaagaatttgcagaagcacttctgcacagagtcaaatcggcgtatccggcttttgagcgggacaagtgccgggcgctgatatttcaggaagattggcccggactgacgttaaaacagcggatgcgccggatcacagactctttatatgaaacactgccgaaggattacatacgggcgcttgacgtcttatatgagacagctccccatttcacagggctcgccgggattatttttcccgattatgtccaacagtacggaacggatcactgggaagaatcaatgaaggcgcttcagtttttcactcgtttttccacttccgaatttgcggtccgcccgtatatcaggcttgaccgggagcggatgttcaaagagttcctttcctggacggagcatccggacgaacatgtcagaaggcttgccagcgagggctcaagaccgcgcctgccgtggggaatctccattccggctcttcttgaagatccttctccgattctccctgttctggaccgcttgatgcaggatgactcgttatatgtcagaaaaagcgtggcgaataacctgaatgacatctccaaaacccatccggatcttctggcacagaccgcagccgagcggttcggaagctgtccgcacacggattggattttgaagcacgcctgcaggacactgttaaaaagaggagacaaacaggcgcttgcgattttcgggtttgaagacgcctcccggatttcattggaacgttttacactgaattcggaaacggccgccatcggaacaagcatacatttttcttttcagatccgctcagccgcccggcaaaaagtcagggttgaatacgcgattgattttgtaaagaaaagggggcaccgcagccgcaaggtgtttaagatgtcggagtccgccatggataacggaaacgtaaaagccttcagcaaacgtcattcccttaaagatttaaccacccgcaagcattatcggggaattcacactctgtctgtcatcattaacggaacggtaaaaggttcgcttgatttttctgttgaataaaaaaacccctccatttcatagatggaggggtgtggagcttattgcgggctgccgtaaagctcttcaagaggtttcataatgattttgtttaactcgccgatcagcatgctcatgcgctgttccgcttccatcagctgagaaatcaattcatgctgctgtacgagagcaaccgttttttgtgcctgctctacctcttcctgagtgatttcttcacctgacatctgtttctgctgcagctgcatctgtacattgcggaagttatcaaacatgcgttttgcggattcatctgcgtttacttgatcataaagccctctcagacggctgtattcatcactgtttcgcaaagctttttcaagatcatatgctgcatcataaaaatgaactgccatagtaaccgctcctttcttcctttcggacataccactccactataacagactgcggagcgactttcatcatcggcgtatgttttccttagaaaagaatgacaaacaaagcctgaattgctccgattatcccgccgagcagaccgcctaaatacgttatcatcttaaattctctcttggaaatcgacagcaccatttcttccagccgttcaacgggaaactgatcaacctgctctttgaccacttcctcaagacgcagccgtttcagcacatcctccaaatgagcggcaatactgccgagtgccgcatcaagcagcttcggcgcgtacgtccccgtaatctccccttcataacgggagatgatgtcaccgagccggcattcgaaaaagggcgcggtttgaagtgcggccaaagcccgctttttcatgctgaacagcagatctttcgcattccacttttcatcggcctcataaagtgtataagatttgagcttgccccattcttgagaaagcagatcagccagaagctttttcgtttcctcattgcgcaaaaactttaacagctcaggcagcacacggtctgccaagcttgaattgccgaggaacatctgcaccatgccgccgagcatcccccgggaattcaaaaagtcgtcaatcatatttccgagtctgtctttcccttcttcgctctcaaaataatcaatgctacgcttcaggatataatctgcggccagcgggattttttcatccagcttttcctgcagctcatcaggaagccagtctttgatggcgcggtgctcatatttccggtacaggtccgaaagcttttcatcggtaaaacggtcaatccaggcatccgtcttttcctgcggattccggatgcccgcggcggccaaagcttcgtgcaccgtcatttcggaagcggccattttttgcgtgaattgttcggcgaaaagaagcgcctggtttttaacgttatctgataaaagccgcttttttattccttccggggttaaaaggtggttcgtcaccatgagccccatttgttttgccaattcatcccgtcttttcgggatcagccccggcgtaaacggaacccgttttccgaacaggtaatacggccggtacggacgaaataacatctgaatggcaagatgattcgtcaccgcgccgatcgcggctccgatcacgatcataaatagaaacgttcctgctatgcccattccttttcttctgcctccatcttatgttctattttcttgatgatatatctattcgtattatagaggctggcgggcatgcgggcaaatgaagaacctgaattgttgtttgtgaggaataaggcaagatgctgtttcgtactctttacagtagatcatcttttatgatgcgcttagcatatttattggatggaagggccgttccatcagcggctttttgaataaagggggagtagtaatatgacaacactcggttttatgtctgtatcccgccggcacgaagaagattacgccggggaattggctgaaagagcgcctcaatataatgtgcgcttagcccgctttacaccgtttgatatatttccggattctttgcgcgtgaaagcgctcgtctatcacccgcaaagcggaaagtggaacgaaacggaaatcgatattcccgaatatatttacgaccgctgtttttacggaaaatccgctgaagcgcaaaaagccaaaccgatcgtcgaatggctgaaaaaatatccgaaaacggaatttatcgggcgggggcttcctgataaatggacggttacagatgcgctccaaaagcatcatctgatcagtccctatattcctgaaacggccgaagtcagccgctatgaacaggtgcaattatacttagccaaggaaaaagcatgtatacttaagcccgctttcggcgcgggaggcagaggcatcatcctgcttgaaacaggcaaaaaatcaattaccgccacttactatatcggaaaaaacaaacaaacaaaatcattttccaatcacgtgtcttttaagtcttggtgcaaaaaagtgctgcagcaccgctatttgcttcaatcctacttaaatatccaggataaagaacggcatccgtgcgacatccgcattttcatgcgcaaaacggagtcaggcgtttgggaaacggtcggaaaagcggtcagaaggggttatcagaacggtcttttatctcatttgcccggaggatcagaaccgattaagtttgacatatggtttgaggaaattccgagaaagcagcaggccgttttattggatgatgtcttttcgatcacccaatccgttccttatttccttgatgaacggttcggaccgctgtttgagctggggctcgatatttgttatgccaaagacggacgcatctggcttttggatgtcaattcaaagccgggacggaaagctattttaagcgtggctccggaggcgaaagaggatttgtatacgggtccgctgagacgcttccgcgaacttcagtcacaggacagcaggaagggagtattaccgcgtgaatcataaagggatgattgtcggcatcgataaaaaaagcaaaaatacgctgtttctcccctcctccatgaaacgggaagggcttttatccgctgccttcgggaccaaggttgtcaaatgccgtgtagccttttctcaatcacttgaaaaaagcgcgctcctttctgaagatttgtttgaggagctgttgataccgtataaaagccgggctgactttctcatacacggccagacggtgcacatcggaccgctgatcggcgttttcacagccgggttcacatcatcgccgtcccgcccgttaagagaccgtacagccttcttttccaagatgctctcacttcatgaacaggcgaacggatattgtttcgttttcggagctcatcagatcaactgggaagaaggcaccgtccaagcgctgatttataaagaaaacagctggaaacggacgtccgtcccgcttccgaatgtcgtatatgacaggctcccgagccgaaaaacggaaggagttccgcttttacagcagacaaaacagaggctgatgaatgactatcagattccgtggtttaatccgcaattctttaataaatgggacattcataagcttctggaaaaaaacagtctcaccgcttcacttcttccaaaatctgtcctgcacccgaatgcagaggcgttagagacgttatgcaacacatttgacaccgtctatatcaaacctgcagacggcgcactcggaacggggatttacagggtggaaaaaacagatgccggcttatctgtcaaacacacgaatgaggaaaaaacggtggtgacggcagagtattcagatgcggcatccttcatgaaatcatttaaagaaaacaatgacccgtccgcatttttaattcagcaaggcattgacctgatccggctggatggacgccccgtcgatttcagggtgcacacgaataaaaacgccgaggggaaatggacagtgacggccattgcagcaaaaatttccggtgaaaacagcatcacgacgcatctggcaaccggcggagaagtcaggacgttagctgaattatacggcgatccgcgagagagagtcggcatgatgcggaaactttccaaagccgccttggcggtcagccgcgtgttaaatgagcacattgaaggttttatcggcgaaatcggttttgacctcggcgtcgatcattcagggaaagtttggatgtttgaagccaattcccgccccgggcgcagcattttttcccatccgaagctgagatcggtcgattacctgacaaaacggagaaattttgaatacgcgtcctatttatcagaacggtccatcaccgccccggaaaaactttggcggtgaggctgtctttttttggttttacccgggacaggcacagaatgatgagctacaatgaacaagatcaacatttcctacaaggagcgtgaacgtcatgatttcgcacttcagctggaaaccgttattcaaaaaagagaaactgcccggatggcggatttcattttactggcagggtacgcattacgaaggggtttaccataagtccggtgacattgaatggggacacacacatccgggaaaagaagagccggctctcgtaaaagagctgcacgaattaatgctttatcacatatatgactgaaagctaaaagctcagccgcatcaggctgggcttttcttttcccttccgctatttaccacccggttttccgaatgagatgccctttgattcaccataatacgtagtacaaagcggcaaacagcattgggtgaagccgagctggcaatggttttcattccgaaaatcatcggctggtgcaattccagcaaacccaaccatactacttaataaaggagatcatacaaatggcaaacaacaactcttcaaaccaactattagtacccggcgctgctcaagcaatcgaccaaatgaaatacgaaattgcttctgagttcggcgtaaaccttggcggagaaacaacttctcgtgcaaacggttctgtcggaggagaaatcacgaaacgtttagtatctttcgcacagcagaacatgggcggccaaggcgtacaataactcaataaatggcttacagaaggcgcgggataccgcgtcttcttttatgccgtcacccttttttcctattccacataccctaggaaaaaaggagggaaaacatgtcattcattgcctcagtcaattgggagctgtttcagttcgtaagtgtttctttggtcaatgaatatgttgcccaccatttcccgtttattcacaggcattcttttccccgctgctttgaatgatataatgagcggcgaggaggttttttacatgaacatcgctttactcggagcaacgggaagagtcggacaggcttttataaaagaagcgcagaaacatggacacatggaaatattcgctcttgtcagatcagccggaacagtccttcccattcctgaaaaacagatcataacagggaatgcgaggcggcgggaagatgtcagccgattgatttccaaagcggacacagtcgtgagctgtctcggcacggacggtgacgataccctttcagccgctatgacccatataatagacggcatgaaacggcatcatgttcagcgtctgattacgatcggcaccgcgggtatccttcaatcacggcttatgcctgatcaataccgttttgaatcggcagaatcaaaacgaaaatcaacaagagccgcaaaggaacacgcccgcgtatacgagatgctgctggcagaggatcttgactggacgatcatctgccctacctaccttcctgacggagacgctgccggagtttaccggttcgaacaggatcgccttcctgaagacggcgccgaaatcacagtcggagacacggcacattttctgtaccgcgagctgatcagcccgcagtttgtcagaaaacgggtaggactggcttactgaatgaaaaaagggcgaatcttttgattcaccctttccgattacaccgcggatttcgccgttcctttctgtaattcatacatttgatggtactgccccttttgcgccattaattcgtcatggcttcccttttcaatgatgcggcccttttccagcacgagaatctggtctgcgtgtctgatcgtggaaagccgatgggcgataataaatgtcgtgcgcccttcttgaaccacttgcagcgctttttgaatgaccgcttctgtttcggtgtcaatgtgcgccgtcgcctcatccaaaattaaaatggccggatcgaacacaagcgctcttgcaaaagaaatcagctgacgctggcctgaggacagtgtgccgcctttttcggtgacgggctctctgatgcccttcggcaaagattgcagaaggcttgcggcgccgacttggcgaagcgcttcttccgcctgctccagagaaatacgctgatcatcgagtgtcacattggagccgatcgtgcccgagaaaagatacgggtcttgcagcacaatgcccatatgcgacctcagctcctgccttgacatgctgtatatgcttttaccgtccagcaggatatcccctttttgggcatcataaaaacggaacagaagattcaggatggagcttttgccggaccccgtatggccgacgagggcgaccgtctcccctttttcagctgtaaagctgatgtgtttcagcacctcttctccctttcgatatccaaaagaaacatcgcggaattccactgtcccttccgcctttctgtctgcgggagcgccttcttcttccgtttcctcctcctgtaaaagctcgaatactctggcggcagagacacgggccaattcaagcttcgaaaattggttgacaatccccgtaaccggctggaacaaacggtttaaataatcaacaaatgcatataaaacaccgatcgaaacaattccggccgcactcagactcgcgcctccgaaataccagatcagcccgacaaacgccagattgcgcaacacattgacaagactgtgggacatgagggaatttaaggacagcattttgtttttgtagcggaaatgagcttcattcaattcttcaaattccttcatcgtttccttctcgcggcggaacgcctgaataatcggcattccttgaatggactcgttcattttcgcattgatgtcactgttaatggaacggattttttgattgaagacggatgcatatttgcggtacacaaccgaccagatcattaaaatcggaataatcagaaggcaaacggcggccagcctgacgtcaagcataaacagcgccgtaaaaatgccgagcatataaacgccgcttgtgataaatgtcgacagcaccgttacatataaatccctcaccgcttctgtgtcattcgtaatacgggccacgacttttccggcaggcagattatcaaagtagcggatcggcattttctgaatgtgtgaaaatacatcctgcctcatgcgctgtatgatccggttcgctcccatctgcagcagataatgctgaccgtaatgaaaacatacggaaaacatgagcaatcccgcataaatggcggtcaacgtcagcaatccttttatttccggacggtaaaattcaaaaatctcctgtcttgataacgtaatgacgggatatgacctgctttctttaccgtttgatattgtcagccggccgtcagacaccgaacggtttccgtcaaaactgacgggacggtcaacaaaatagtagcccgcaccgacttgataaatgtgcgcctctccggttttatccgcccccggtttgagccggtcctccctgacataatcatgcccccggaacctgacggcgcccggatcgtccgcagaggctttaacccatgttttttcaatgccgagaatgtggtcatcaatcattttttttccgataaacgggccggtcagctcagtgccgaccgcaataatgagcaggacgaccgcccatatcagcagcttcttatattgaagcgcgtaattccataatcttctcccggtcttcatgcgcccgtccccccttcttcaagagaggacagctgctgcctctcatattgttttcgataccagccgttctgcgccaatagctcccggtgcgtgcctctttcagacacccggccttcgtccatgacgagaatgagatctgcgtgttcaactgccgagagccggtgggtggtgataatcgttgttttatgccgccgttttttacggatgctgtcaatgatggcggcttccgttttcgcgtctacggcagaaagcgaatcatctaatatgagaatatcaggatcggtcaaaagcgctctcgcaattgagatgcgctgcttttgtccgcccgagagcgctacgcccttctcgccgacaagcgtctcaagcccgtcggaaagcatgccgatatcgttttcaaaatgcgcatctttcagcgcgccgccgatttcctcttcgtttgcatcctgccgtccgtaaagcagattctcctttacagtcttagaaaataaaatatgatcctgcggcacatagccgatccacccgcggagctcctcaagcgggatctcctgaatcgggacgcctgtaaacgtgacctctcccgcaccgggcggatattcacgcagcagctgcttaatgatcgtcgtctttccgcttcccgtcttcccgacgatgccgagtgtctgccctttttctacggaaaaagatacatcggaaaccgccggtcccgctccgctcggatacgtgaaagtcacttgttcaaaaacaagacgcccgggctccttgatgccggcggggcgcttgggcccgatcacgtcaggctcataggaaagcgtctcattgacacgatccaaggaggcattgccgcgctgcatgatattgattaattctccgatcgcaaacatcggccagatcatcattccgaggtacacgttaaacgataccagctctcccagcgtcagccggttttgaaaaacgagataagcgccgtagccgagacctatgagatagctgaggccgacgagaagtttcacagtcggttcaaaaagtgaatcgataaacgccaccttcatatttttctcatatacatccgccgtcatatcaccgaaccggctgacatcatttttttcctgcacaaatgcccggatgacccggacgccggataccgactccagcaccttgtcatttaatgatccgaaagcatcctgcgcttccgtaaaccgctcatggatcttttttccgtacaggctgaccgcagccgccattatcggcagcggaataatcgcggcaaatgtcagcttccagctgatgagaagccccattgtcaaaaatatcgtcagcatatacatcgtcgaatcaacgagcgttaagaccccgaagcccgtcgtcatactgacggcctgcaggtcatttgtcccccgcgccattaaatcgcccgttctgtatttctcgtaaaacggcggtgacatttgaagaagccttcccatcagctttgaccggagaattttctccatgacattcgccccgccgaaaagctgatacatccaaaaataagacagtaaatagacggctgccgttaatgcgagaaaaacacatatgtaaaacagcatcccgcttttcgtaaacacgcccgccttcatatcgtctatcgcattaccgagaagtttaggcggaaacatctcaatgacattcacaatcaataacagaacaatcgctgtcgtatagcgcagccaataggctttaaaaaaccacgcgagcttttttaatacagtaaacaaataccgtcatcccctttcatcaatcagccgccctcaagcttttccggattgtttttcattgttttcgctaatgccgccacatgcatcacacctgtctttctttcatttttttgtataaaaaaagacatgaagcctcagctccatgcctcttattattataaataaggtacagacccgccgtttatgcgcgactgccccgtttttaagcaaatgttcagaaaacggaagctgtatggaagtcacgccggtattcagctgaagatgagttgacaagctttagttttgacatgatccatacctcctttttcctatattgttccttcatcatataaataaatcctttttttgtcaatgcgggttttacatttctgccgcacgggtattgtaaaacaaaccttttttactgaaaggatgaggctgatgtttcacgcagaccggttgatagcagcttttgacggaagtgatgatagtaaaaaagcgcttcaaaaagccatagacctttcaaaaacgttccacgcggatttaacggtcgtacattcccacagtgcaaaagatacccagacgattgttgatcccccgaggccgggagccggggcaacgtatatcggcggcgggattgcaagcgttcctgacccgcttcaggcggaaagaatctcccctgatccgatgatttatgaagaccgtacggaagaaatcgttgcggaagcgagaatgctgatgaacgacagccagattgacggggatatcgacattttagaaggtgatcccgctgatgccattatcgagcatgccgaccgtatatcggcggatttgatcgtcatggggagccgggaccagaacaggctgaaaaaacttttattcggaagcgtcagtgaaaaactgtcatcgaaatccgatattcccgtgctgatcgtaaaataattctttctgtaaagcagcttaatcaaaagctgctttttttacagctcccggctgttttttctttttttcggcattacaaaaaaactcgccatgatcaaaaaatcgatgcacaatacgacagaccagccctttaacagtccgctgagcgcttcggtgcgggaagcgtcctgaatgagaaataccgttccggctaaaagaacgccgccgatgacaaatgctaatacatgtcttccccatccttttgcataatgtttggcataatccagtccgtaccgcttgaccggttttgccccttcctttaccacataatagcggaaccgctcatccgcccactgaatcatgctttttccgaaggcgacagacactccgatataaacggccgccactgcatgcgccatagtcgccgccgcccctctgtataaatcagctgcggccgccagaaacagtacggcatccaatataggaatgagagcgaaaaaaaacattccgagcttttgccgcctgaatatatagcgcgccgccaatccgaagatgacagccgcccaaaaagcagcctcacaaatgacaatcaaccaagcaatcgcgttcaatccggttcccccttatcgttttctaaaatgcattgtatcactgctttttatttaatacaactgtattacaaaattgcaagaaaaaatatttcctgttacactggaaccatgcctaaaataatcgatcatgaaaaaagaagaaaacaaatagccgaagccacttggcggacgattttggagcggggaatggaaggagcgacagtgagaaacatcgcccaagaagcgggtctttctttaggcgcgctgaggcactatttcaccacccaggatgagcttttagggtatgcgatgacactcgtaaaagaaaaagcggccgccagaattaacgaagttgccatgaaagatctgccgccgaaagaaaaagcggtgcgtctgatgcttgaaattatcccgacagatgaagaaacgatggctgaaatggaggtgtggttcgctttcacagcttatgccagacataagggagaagagtttcaaccccagcaggacgggatcttggcatatatccgcggcctgattgactggctggatgaaaataagcttctgaaaccgaatcttgataaagaaaccgaagcggagaaaatgtacgctatcgccgacggattggcgctgcatgccatgcttgaacctgatcgtctttcaaaagagaagatctcccgtgtactcgttcagcatatcgaatctctttttatctgactggagcaaaaaggccggatgtgttccggcctttttttcagcttatgactgaacgccgagctcctgctgaatgtgcgactgaaaagcctcctgaatcgttttggctacaggtcccggcgatccgcttccgaccggttttccgtcaagggttacgatcgggattaattcagacgtggttgacgagatgaaaatttcatccgcatctctgagttcctcttcggtaagagccttctcccgcacctcaatcccgttttctttcatcagctctaacagtttcatccgcgtaatgccgtttaaaatcagctcatttgcaggatgcgtccggacggtgccgtttatgacggcgtatacattggatgaggttccttccgtgaccgccccgtcccttatcagcacggcttcataagcgcctgcttcataggctttttgttttatcatcacattatacagtaaattcagactcttaatgtcacacctcagccagcgtttgtcttccgccgtgatggcctgcgctccggctttttgttcattttccggttttttcactgaaaaggtgtatgccgtcgtctgcggctccaatccttcgtcatactggtgcttccgcggcgccttccctctcgtcgtctgtatatagaccccgccgtcaatgagtttgttttcctgtacgagcttttgcagatcccattctatgtcctctgcggagaacggcagggtgatgccgatttctgcggcgcttctgaaaagacgggcgatatgctcacgcagaccgaataaggcgccgttatacactctgatgacctcatacacaccgtcaccgaattgatatccgcggtcctcaatatcaactgccgcttcttcacgatcaatcaactggccgtttactaatgtcttcatgtaaaccctcctaatcgttatctgccgtgatgtgcattctcagctgttattgtcaactattctatcatactgaacgagccggctgcggagtttatttttttcttaaaatcttattattcgacatcttttctatgtcttttccagttttgttcctgtatacttgattcgacatacatatgctgttaacttatggcacttcgcaagcctccgctgttatcggcattatgcagaaacttatgctactggagagattgttatgcgcaacacaaaagaaggtgcttccccttctctgttttcattggcttttaaacttacgagtttagcagttttgtgcggactgcttctggtaatcgtcataatgggatattccgcttccgccgcaaaaaacaaacaggtcaccgtgaccgcaaacgggcagcttcgggatgaagcagaaagcctgcggctgaaaaatgattctcccgacgtcttaatgaaacatttgcagaaagagcgtgacccagggaaaaaaacggtatatttaaccttcgacgacgggccgtctccatatactgaacagctgttgaatgtattgaaggcaaatggcgcaaaggccactttttttatgcttgaaccgcggatgaaagcctataagcattccgtgcaaagagcgaagcaggaagggatcgcgctgggcctgcacggcgtgacgcacgataatcacctgttttatcaaacaccgacatcaccgctgaacgaaatgcagcagggacgcgatacgctcgagacaatcactggagtaaaaacggatcttgtccgcacgccttacggcagtaaaccctcattgacggatgcccagattaagaatctcgaaaaagacggattcgtgtactgggactggacgatagacagtgaagactggaagtacaaaaacgcgcggtacgtgccggaagtattgaatcagctcgcatatttggaaagcgttcatacgagcaggccgcatgtcattttaatgcacgatctgcctgcgacggtgcacgctttaccgagcctgatccaaaaactgaaagcccagggctactcctttgatgttctgacggatcaaatgattcccgtccatgaataagaaaagccggatctgtataggatccggctttttttatgtcgcggcgctgatccgttttgcaaattcaccgatcttctcatggatgacaagatcaaataaatggtcgcaatatgtcggctcaaggttaatgatcacttgcttcaaaccgggaatccggcccgcatcctcagggacaaaccttgccggcgccacttcaagcgaagtgccgatcacaagaagaagatcagctttatcaagcttttcataaagggtttcaaaatgctgaacgagatcgccgaacagcacgacatccgtctttaatacggtgccgcataccgcatgatcaccgacttcggccgtacattccggcacttcgtccttcagcagatgagaaagcccgtagcgcgctccgcagcgggggcatgcggcggtctgaattgaaccgtgaagctcatagacactgctgcttcccgctttcttatgcagtccgtcaatgttctgcgtgaaaatgtctacctgctttccccgcttttcaagatccgccaaatacgtatggccggcattcggctcatagcttccgctcattttcatctgaaagagctgtttgaatttaggccagaattcacgcggacggcgttcaaagtattccctgctcatcgcttccattctggaggtgtcttcggtccatataccgcccgccgaacgaaaatcgggaatgccggattccgtgctcattcccgctcccgtcagcaccaggatacgttcagcctgattgatcaatgttataaacgcttccactcttccaccgccttttctttttatcatatcatgaaaaaagaacggcgcctgttatgcccgttctttttctccggaatgatccttcacatgaaccggatcatcgtggctcttctgttttacgaatacattctggcccggataggcgaactccacgccttcctcagcaaaaatatcaataatccggcggttgatatcctgccgcacgtccaggctttccgcccagacgatggtctttgtgtaaaagttgaaaaacagattgtaatagctgtccgcaaacacgtcaaagttaaccataatcgtatcatcatgcacgccttcatgttcacgaagcatttccctgagccttgtgatgcaccgctctaaacgatcaatcggcgtcgcataagaaacacgaacggaaaacgtgacctggcgcttcgtcatcctcgtccagtttgtgatggcttccatggacagcgttgaattgggtacggtaacaagcgccccctgcgccgtgcggaaccttgtgcttcggaatgtgatatcttcaacgccccccgtcacagatgacgtctcgacccagtcgccgatcgtaaacggcttttccgtaatgatgataatgccgccgaaaaaattgctgatcgtatctttagccgcaagcgcgaaggccaagccgccaagtccgagtccggccacgaacccgtttacatcataattgaattcctgcgcgatcacactgacgctgagcgcgagaatgacaaagcgcagcaccttggataaaaacggcgccaaaatgtcatccatatcaagctcaaagcgctgattgactttatgaaataaaaacgaagacgccgatgtcagattgcaaagcccccaggcgatcagcgctatgatcaaagagcggtacatttttttgacaatgtccatctgcccgtctaaaaacggcgaatactcaatcgccaaaaacagacccagcgccacgaaaaaccatctggccggcttgtcaaacgctacggcaatctgtttgaatatgtcggttttcggcttgttcgccaatttgtaaatgagctgaaaaaagtatttgacaaacagttttctcaaaacgagaaaagccgctaaaattccgatgctgatactgatctgcaaaatatggtcaagagtaaaaaagctctgaaattgtgtcatcatggcatatgctcctttgtcttgtcgaaaatctattatactaaaacattcggacatcagcttgttttaatgtctttaggcagcctgaaaaaccccggcctcagagcacagccggggtttttcacacattcgttcatctttcagccagatacaacagggtcaggcactatttcttctttgattgtgtctgtttcaggagagtcgctttttggatttcagcatcggtttcggccttaattctttcttccactttcaatctcccttttcccatgatctcgcctcctttttgccattataaatcatcactgcggattgtaaaccgaaaaaagcactatctttattccaaaaaaatactgttttgcacattcaccagtttgaatcgctgtgcatatacgaatctgatataataacagaaatgcccatgaggggagctgacaagcttgtataccatcgctcatcgcggcgcatccggttacgcgcccgaaaatacatttgcggcatttgatatcgctgccgaaatgaacgctgatttcattgagcttgacgtccagctcacaaaagacggccagattgtcgtcatccatgatgacaaagtcgaccggacgacggacggctccggttttgtaaaagattttacgctgaagaagctgcagtctctggacgccggcagctggtatggggctgagtttaaaggggagcggattcccctgctcgaagaggttctgaagcgttatcattctgaaatcggatttttaattgaactgaaagggcacgtttctcaagtcggtcttgaaaaagcagtcggccagctgttaagcaggtttaccttttccattcaccctatcgttcaatcattcagtctcaagtcgattcagacctttcacgacatgtatccgtccgttccgactgcaattatcgcaagacccagcttcgggatgttttccaaaagccagctggccgcttacaaatcagccgcaaattatgtcaatattaaatatacccgcctgaatcggttcttgatttccaccgctcacaaacacggcctgaaagtatttgcctggacggtcagaaatcacaagacggccgaaaagctgcaaatgatggcagttgacggcattgtaactgattttccggatattatttctaaggatggctgatatgaaacaatacatcgcaatttttatcggaggcgcgcttggcgcattgctccgctttgaaatgagcgcgcacattcacagcggaactttcccgggtgccactttcctcgaaaacgcggcgggaagccttttactcggtcttattacgggttatttcatcattcgggctaaacgccctcttttgaccgcctttttaggaaccggtttttgcggaggtttcacgacgatgtcaaccttcgcaaaagaaaccatttttctgctgcaatcgtctcccgcagcggctttttgttatgctgccgcgactttattcgctggtcttgctcttgcatacgccggcatttttttgggacggcggattgcccttcacgcagccggaagggggcatgatacgccatgacgattgtcctgatgcttatcgcggcgggtatcggagcggtattacggtctctgctgggtaagacaatttcagaaagaacaaaaggttttccgattccgcttggaatggctgcggtcaacctgctcggctccttcagcctcggcatattcaccggcttgggtctggataatccttctgccggcgtcatcatcgcgacgggctttttcggtgcgtttacgaccttttccaccttcagtattgaagccgtgcagctgatgatgaacaaccgcataaaggaaagcctgctctacatcgctgtttcagcagccggaagccttttggcgttctggtgcggctttgttatgatatccatttaaaaaaaccttgagcttatttttcgctcaaggttgcgttatgaagcatgaccgtttccggcacgggcagcgggcggtttattgtcccctgaccgcccgggcggccctgttcttctttgagttcaagctgtttaataaaccggccgtccatttctaatatgagggcagtgtatcccccgatttgtatcgactcacccgcacaaatgtcaatattccgtttcagcacaagaccgccgatcgtgtcgacttcctcttcaatctctgcgccgagaagatgattcacctgatcgatccgaacctttccgtccagcacataatggcgttcggacagcttttgaatctgcggctgttcgtcctcatcaaattcgtctctgatatcgccgacgatttcttcaagtatgtcttcggtcgtcacaagaccggacgttccgccgtattcatcagacaatatcgccaaatgaatccgttctctctgcatttttatcagcaggtcgtgtatcgggatcgtctcgatgacttcaatcaccgggcggacgtaagacatgatggatacttccgctttttcatcttctgtcataaacagcagatctgaaaagagatgcttcgtattgatcatgccgatgacactgtctttgtccccgtccgttacgggccagcgcgtatatttgtctttcagcatcatatcaagcatttccggcacgtccatatcagtggaaacagccgcgatttcttttctcgggatcatgatttccttggcgatccgattatcaaaatcaaaaattttattcacaaatgtatattcagacggattgatttctccgttttttaaactttctgacagcaggatccgcagctcttcttcagagtgggagccttcatgctcagatgccggctttaatccggccaaaccggtcagaattctcgcggagccgttcagcacccaaataaacgggaacatgaacacgtaaaataaccgaagcggtccggcaatccataacgtcagcttttccgctttttgaatcgcaaccgttttaggcgcaagctcaccgacgacgacatgtaaaaacgtaatcagcccgtacgccgcagcaaaagcaatcacatgctcggcagaatccggcagccccataccctgaaacacaggatgaagcatccgctcaaatgcaggctctcccagtacgccgagcccgatggatgtgagtgtaatgccaagctgcgaggcggataaatactcatcaagatccgtaatgatacgctttgcgagcaccgcccgtctgtttccttctgagatgagctgatcgattctggatctcctcactctgacgatcgcaaattcactcgccacgaaaaatgccgttaacgcaatgagcacaccgattaaaatcaaactgtcaatatcgtccatttcaccttatcccgaattgaaggataaggacgtcacctcctgatttcatcgttttttcttaagcgagaggaacgaaatgggtgattgactacacagagggccccatcctgccacctcctaagtcaaagcatgattgtcatttgtatagtttattgtatcacaactccattctttcatcattttcagatttttcatcatataaaaacagccttcaaaaagaaggctgccgttatctgcttcggaaatgattttctaaacaaagcgccgtattaatccccccgaatcccatgcttaagcttaacgcatggtgtacggtatgggcgctcggcccgtcggtcacccactgaaatgaatcgtcaatcggctccgttaagtttcggatcggatgaagcttgttttcccgcatttgcaagagaacagcaatgatttccaccgttccggccgcactcagaccgtgtccggtaatcgattttgtcgcattaatccgcgcgtgcgacaggccgctttcagaaagcgcccggcattcagtcttatctccgatcggcgaaccggtgccgtgcgggttgatgtaatcgatctctttcgctgaaagaccggcccgctccagcgcctggcggatcaccgtcatttcgccctctgctgaaggattcgggttgcggttcgcatcggaagccatcccccagccctttaagccggcccacgatcgtgcgcccctctcttcggcagattcagcgcgctccagcacaatcgccccgcacgcctctccgaatataaacccgtccgtatgccggtcaaacgggcggcaggcggcttcaggccgttcagcgtatgtatcagtgcccatcgctcccaaagaacggagagcgtgacactccatgtacgacagatcggccagcgccccgatcacgatgcaccggtcaaacaggcctcctttaattccttgagcagcctggataaccgccgcctggccgcttgccgacgcgccgccgaccgtaaaggccggcccttttatcccgaattgctccgtgcaaagccccgacaaatcactatccataaaagaaagcccgtatgtcggatttacaaattgcggcgtttcaccgtttttctcaaaggcctgcagcaattcgcgctgcgtcatattcgacccgccgatgatcagaccggtgcggctgtgatcagcgccgtctaattgagcgtcatgccacgcttcatataaagcgataagcgccgtctttcctgataatgcggcccttcggtacaagcgcttcgacagcgcgtccggcggcgttaattcgctaagctccgcgccgataaacgaactgcctttctgccggccgggacgtttcatcacatcaaaggcgtgccgcccctccatgagcgcatcgagaaacgcctccttgccttgtccgaccgcggttaagactccgattcctgtaatgctgatgtctgatgtgccattatttctcctcgacatttgtccgttctcccatctttatgtgttggaagctatgaagaaaaatcttgatacagtgctttgaaaatatcgcgcgactgtctgatctgttccgaaggcacgctgaaagataatcggaaatagccgctttttccaaatccgctgccgggtacgatcaatagtctgtatttctgtgcggcatgcatacagaacgccacctcgtcttcaatcggtgatttcggaaagacgaaaaagcctcctttcggcatttcaaattcgaagccggcttctgtgaggatgtccaccataaggtctctccgctttctgtaaggttcagcgtcaatcgaaagatcatccattttcgccacggcgcgctgcatcatgaccggagcgttcacaaagccgagcgtccggttgcagaaaacgaacgcatccgtcagaagatcgccctcaggcatttgggcgtccgccgcgatatacccgagcctttcccccgcaatgccgagatctttactgaacgaactgactaaaatcacgcggtgatacgcctgaaacggattcgcctgctcttctccgtagatcagctggctgtacggttcatcaaataaaataaatatgctttggccgttccgctcttcggcttcttttaataaggcgcctaattcgttaaggtttttctggctgagcacagtccccgtcggattatgcggcgtattaacgatcagtcctttcgtacggggtgtgatcgcacctttaaccgcttcaatatcaatctcaaatgagtcagtcagcgggcagatgacgggtctgccgcggtaattttcaacatacgctttatattccgcaaaataaggcgaaagaaggatgacttcttcctccgggtttaaaatgctcttcagcgcgacattcagcgccccgccggctccgaccgtcataactgtatgcctggcggaaatctcggtctgaaaccgctctgacaaaaagcgggcaaccttttctctcgcctccggaagcccttggttttgtatgtatccgtgccgccctgtttcagccgcttcgcaaagcgcctttttaaacgtttcaggcggctccgcaaccggatttcctattgaaaagtcaaacaccttatcggcgccgaactcttttttcagccgagcgccttcatcaaatagtttgcgtatccatgaacctttctccaggttctgtgtcacttcccttgataaaccggccactgtcatctgtcccttctgtctttttctgccgtttctatttacaatgattatgaaagatttacatggcgcagtcaacgctttttcagacagcctgccgccccgtttcaggagaaagacggaaaacaataaacttgtgcaaactccccttcatatattaaactattctcataactataacgtgatggttggggagggatttagatggggctgagacttatcgcatcagtgaattagcagagcttgccggtgtaacgaaacgcacggtggattactacacaaacctcgggcttttaaagcctgacaggtcttgttcgaactatcgttactacgatacacttgcacttaatcggttaaagtttatagtcgcttgtaaaaagcagcgattggccctgtctgatataaaagatcgactggagaaccagtttccctcttcagccctgcctgacgatgttggaaatctggcatcggaaattgatcacatgaatcaaaacatctccgggatcttgaatcggtttgaaaagcttgaaccagaggagcgcgcccagctgaaaaaaaggctggctcctgaaaagcttgcagtgcttcaatcatttatgctgctgttaagttaaaccattatcttactaacaggaggtgttaccttcatcttcccaaaaggagtgaaggttctaattggacattgtgaatttgattttagtcgcggttttaatcgcgctgacggcatttttcgtagcatctgagtttgcgataatcagaatcagaggctcacgggttgaccagcttatagcagaaggaaataaagccgcaatcggtgtcaaaaaagtgaccacgcatttagatgagtatttatcggcgtgccagctcggcataacattgacttccatcggtcttggtgtcttaggcgaatcaacgattgaacgcttgcttcacccgcttttcacaaagataaacgtaccaagctcattatcgcatattatttcatttattctcgcctacgcgatcattacattcttacacgtggtcgtgggagaattggcgccgaaaacagtcgccatccagaaagcggaagccgtttcaatgctgttttcgaaaccgctcatttggttttaccgcatcatgttcccgtttatctggcttctgaacaactccgcccgtcttttaacgaagacgttcggtctggagacggtgtctgaaaatgagcttgcccactctgaagaagagctgcgcatcattttatcggaaagctataaaagcggtgaaatcaaccagtctgaatttaaatatgtgaacaaaatctttgaatttgacgacagacttgcaaaagaaatcatgattccgcgtacggaaatcgtcagtctgccgcatgatatcaaaatttctgaaatgatggatatcattcagattgaaaaatatacccggtaccctgtcgaagagggtgacaaagataatattatcggcgttattaacattaaagaagtgctgaccgcctgcatcagcggcgaagtatcagtcgactcgccgattacggattttgtcaatccgatcatccatgtgattgagtcggcaccgattcacgatctgcttgtaaaaatgcagaaggaacgggttcatatggcgattctgtcggatgaatacggcggaaccgcggggcttgtcaccgttgaagacattattgaagaaatcgtcggggaaatccgtgatgaatttgatatcgatgaaatcaatgaaatccgcaaactcggcgacggccattacatgcttgacggcaaggtcctgattgatcaagtgaacgaactcctcggcatccatttggaaaatgacgaggtcgacaccatcggcggctggttccttacccagaaatacgacgtcgaacaatacgactcgattatcgaagaaggctgcgaatttatcattaatgaaattgacggccaccacgtcgcatatatcgaagtgaaaaaactggcgtttgatgaactgctggaaactgccgaacaaaaagaagcataacaaaaaagcttgcgcgtctgatacagacggcaagctttttttcatttacagttgttcaagttttttctcaagctctttaattctggcattcagctcttctgtcatggccgcaagcctctccttcggcgcaagatcggaaaagtcctccaaaaaaatcggctcgccgatgataagccgcatttttccctttttaaacagcgcttttcccgtagacggccctttatatgcggccggaacgagcggcgctttccccatttgggcgatggtcacggcccctcttttcagcgggacgtcttcagaagttctcgtgccgctcggaaaaatccctacaatcttcccttccttcagaagcttaatcggcgttttaatgctgctcggacccggattttcacgatcaaccggaaacgcgtgaatcttctttaaaaaacttccgatccactttttctgaaacagctcttttttcgccatataatgaatctgatggggcaatatcccgacaccgagcgtgaggacgtccacccagcccgcatgcgtgcacgcgataacgaatcctttatcagacggaagattctctttattgtatactttgactcctccgcgcagagaaagaatgaatttgatggcatttgcacaaaacttatacataacgcacttcctttgttgtaatgatcaaaagtgttctctctctattataacaatattttttattacctggtactaataaatatatttttcctccgccgatctctatcttttatgacggattttgggtactatagagaaatggtgtttgatgaggtgaaaatgaatttaagccgtttgcatggaacgtgcaactttaaacctttcttatgcgtgtataacatagaggggagaaaaggcagtgacgatcgatgaaatttaccaaatgtatatgaatgatgtttaccggttcctgctctccatgacaaaagacaagcatctcgctgaagatttgctgcaggaaacctttatgagggcatacatacacattcactcctacgaccacagcaaagtaaagccatggctttttcaagtggcgagaaatgcgtttatagattatgtcagaaaacataaaaaggaagtgaccatttccgatgacttaattgggagcctttttcagacggctgttcaaagcccggctcatcagattgaaatcaaggaagtgctgacagggtatatgtccgaacttcccgacaattatcgggaggccttaacactgtattatttaaaagaactgaattacaaagaagcatcccatattatgaatatttcagaggctaattttaaaagtgttttatttcgtgccagacagcggctgaaagcactttataatagaggtgttaatgatgaatgaagaatttaaaaagcgtttttaccaatacaaaaatggagaaatgagcgaccgggaaatggccgcctttgaagaagagctggaaaagcttgaagtctatcaggagttgattgaaagcgaaatgcaggacgaccgggaatgggacgtcggcatcagcccggaaaaacagaaggccattttgtcatacggaaaacgcaaatcgtatttgcggatttcagttctcgccgtcatctccaccttgatgattttgccgctttgcactttgggaagctacctctattacggtttgggaggaaaagaaagcaccggcaatcaattaatggaaaccgcagccgtgacggtggcgaccaccatgccgaacgtactcgtcgatacctccggactgaaaagccaggtgaagctgtttgggatgaatacagagtttccgctgcaaaagcagatcggcacaaaaacgaaatccgtcggcggagaacggattgaaatgtttttagatacggtcaaatcgcctgccgttaactactatgatctagacgcggcacaggcaaagcattattttgcccatccttccggcttaaaggaacgcacgattgacaaagccggacagacattaaaaaaattgcctgaaggaagcgtggcggaggtctatctttcttatgaccgggcctatccttcttctcaagtatattctacttttaaaaaatacgatgtgaagtttttatggaacgcggtcgaaacggagaaaaatctgaaagacagtccttatgccgagccgttaggatttcccgggaaagattccaagatggtgtcctctttcgaaacgcaaggacagacagaccgtgaacaatttatcaatgcccttgaatttatgtcccgccataaaaaatgggcgcatgcaatatcgaaacgcaaagacatgaatcttggcagccgaatcgactatgttgaacatcacggaatgaacgtatacggctctgtcgtgacggggccgacaaaagaaatcgaacgtctgctgaaaaataaaacagtaaaagcagcaaacatcggtgaggtggaattatggaattggtaagaatttttaaagagcataatgttttcggctggatatcagtcggtaccgcgattttgtcgctgctgcttttgaacgtggcaatcatcagcaatgtgactttctattcttatcagatgctgccgtttgcgatggccgccgtgccgttcggcatcattgagctgtttattaaaaaaggacggacgggcccgggactgctcggtgtcatcctcaaccttttcgtcattgtttgtgtatatacgatcgttgccgttgatacgaatctgcaattcggtttttaaacataaaaacaggcccttttacaggggcctgtttttttaaaatgaaagaacgccgattaaatgcagcaatacgacgatgatagccagcggcacgaggtatttcagaaggaaataccacacctgaaagaaacgatagccgatggcggaaccgcttttcatctcggcgaacagctcccgcttcggtattttcagcgggatgaagattgatattaataaagcgccgagcggaatcagcacattgctcactgtgaaatccgctagatcaaaaaacgtttttccgaacaaatgaacatcaccgagcacaccgtatgataaacacgacggaattccgactaagaaaatgagcagaccgcttgtccacgacagcttcttccttttcgtttcatcacctttcccgacagtcgctacgataatttccaccatcgaaaaggccgaagtcagcgcggcaaagaaaaagaccgccagaaagctgataaaaaacagcgagccgaacggcagccggtcaaacacagccggcagtacggtaaacagcagtgtaggcccttcatccggtttaaatccgaacgaaaaaaccgccggaaaaatggccagtcccgcaaacagcgtgacgagcacattcatcacaacaatggaacccgccgatcccggaaggttttgggttttcggcagatacgaactgtatgtcaccatgaccgaaacgccgagcgttaatgtaaagaacgcctgtcctaaagcatataggatggattccggcgtcaaatcttcaaagtgcggaaccaataaaaatctaatcccctcaacggcatgatcgagcgtgactgatcgcagcaccagcaatagaaacagcacgaataaaaccggcatcagcaccgcactgacacgttcaatccctttctgcacgccttttgcgacgaccgccactgtcaagatcataaatacaagctgcgcggcgagagtctggatcggattttcaatgaccgtcccgaacaccgttccgtactgctcctgagtgagcccggataaagaacccgtaacagcttttaacacataaagcaaaatccacccgccgacaacactgtaaaaagacaaaactaaaaaacaggccgccacacccacataacccgtgaggtgccataccgacttcggcgcggcttgtttgtaggcatcaatcgcatttgtctggctccgtcttccgaaaataaattcaccgagcaaaagcggatagcctaaaagcacggtaaagaggacgaatacaagaaaaaaagcgcctcctccgttcgtacccgctacgtaagggaacttccaaatggctcccaggccgatcgccgaaccggcagcggccataataaatcctatttttgaggcccattgaacccttttttggtcagacacgactttccacttcccttccgccctatattatcccttattcactgcgataacttaagcccatttcaatatgtttcattattccgaaaaataaaaaggagcggcgggtgccgctccttacaaatccccgtttaatttcgaatgctttctcgaatataagaaataaatcaccagaccgatgatcagccagataaagaaacggaatatggtggtggcgccaaggttaataatcaaaaatacgcagaacagaatggacaatatcggaataaagggaacccccggacatttaaaagctctcggcagatcaggctgtttctttctcaatacgataaccgccactgaaatcaggacaaacgcggcaagcgtgccgatgttcaccagcttcgccagctcatcaagcgggacgagcgagccgagtaatgccgacaggatgccgaacacccatgtcaccacgtgcggcgttttatgcttcggatggacttttgaaagcgcccccggcaccaaaccgtcacgggacatggcaaacatcaccctcgtctggccgtacagcatgacgagcatcaccgttgtcattcccaacactgcaccgatatcaataatcccggccacccaattctgtccggccatctgcaggacgagagacacgggatggtcaacgccttcaaagcgggcaaacggaacgacgcccgtcataatcgccgatacggtcacatacagcacggtgcagacgattaatgaaaagataattcctttcggcagatccttcgccggatttttcgtttcttcagcggcggaagagacggcgtcaaaaccgataaaagagaagaaaacgagcgccgcggcactgaaaacaccgccgaaccccatcggtataaacggctgccagttgtgaggtttgacatatacggccgcaacggcgataaacaatagaacaaccagaaccttcaaaatgaccataatattattgacccgcttcgattccttaatgcctaagtagaggaggaatgtaatcgcaagcacgataacaaatgcggggagattaaagaatgtgaccgtgcctttaatggatcccggcgcggccgttaatgcggtcggaagatgaatgccgaagcccgccaagaatgattgaaaatagccggaccagccgaccgaaaccgcgctgacggcgagcatatattccaagattaaatcccatccgatgataaatgcgagaagttcacccagtgtcgcataagtaaacgtgtagacggaaccggaaaccgggacgcttgaagcaaattcggcatatgacaaagccgcaaataaacacgcaagagcggcgatgacaaatgaaacggtcagccccggccccgccgtgacagcgcctgttccggttaatacaaaaattcccgttccgatgatggcccctatccccagaagtgtcaaatcaaaggcccctaactctcttttcagcgacttttccccgcccgttgcggcaagcaggtcctgaatgcttttctttctgaatatgctccccttcatctgcttcactccttgtaaatcaatatatgttagaatattcagacaacaatagcaataatgactaaattcttatttttcgcatgaaatgtttcagcacatcattcctttctcctacaccatattatagcgaaaaatataaaaatgaaaataacttttttgaaaattctatatattatttcagttttcataaaacagaactcagcggattctccgctgttaaatattaacattagtaattcagctggcggcttctattttttaaaaatcgtattcatatgtaatcaaataaaaatcccgccctttttaaaagcgcgggataagacttgcttattatgttgaaataaacctgcctccatttacgtgaatggtctgcccagtcatataggaagattcgtctgaagccagaagcacataagctcctgcgtgttccgcaggctgtcctggtcttcccatcggagtgtccagaccgtgcttttccaccttttcttcagtaaacgttgccggaatcagggcggtccagatcggcccgggtgccaccgcatttactctgatcccctgatcggccaatgacatcgccattgaacgcgtaaaggaaacgatgccgcctttcgtgcacgaatagtcgatcaatgatgtgtctccctgataagcggtaatcgacgttgtattaatgatggcgctccctcttttgagatgaggcagcacggcttttgtcatatgaaacatggaaaacatgtttgtacggaatgtcttctccagctgttcagccgtaatatcaagaatcccgttttgcggatgctgctcagccgcattattaacgagaatatctatttttccgtagtgatctaagacttgctggaccgccttctgacaatgcgcctcatcaccgacgtctcccggaattaacaggcaatcggcctggtattctctcgcacgctttttcgttctctcggcatcggcatgttcgtctaggtacaggatggcaagatccgccccttccttcgcgtaagcgatcgcagccgctgcgccgatgccgctgtctccgcccgtaataacggcgacttttccttttaatctgcccgacccttttacatccggatcctccaagagcggttttggctccatgtctgactcaatgccgggctggcggttttgcacctgcggcttttgtccttccgtctgtctgtccatcggattcatattctcacactcctgcaattggtattactgagacgataccacgcagtgcggggagttaaacggacaaatatgccggtaattaaagctgctgagccgtttcgggaaaagcgccggtgtatttcgcagacggtctgtaaatcatgttgtcagcggactgttcaagcacatgtgcgcaccagcctgccattctgcttgctgaaaaggtcggcgtaaataaatcattgtcgacatcaatggcctgcatcacagccgctgcgtaaaactccacattcgtatacagcttccgtccgggcttatattgctctaacaagcggatggcttccttctccacataaagcgccaagtcaagcgacggatcatttcccgccacttcttcagcctttatgcgcagcgcttccgcccgcgggtctttcgttttgtacaccctgtgcccgaagcccatcaggcgttctcccctcataagcttcgctgtcaaatacgcttctgcattttctttttccccgatgtcttcaagcattttcgtgacgcctgaaggcgcgcctccgtgcagcggccctttcatcgtacccagtgcggcagtgacggcagacactaagtccgattcagtcgaaaccgtgactctcgctgaaaaagtcgatgcattcatcccgtgttccatcgccagaatcatatacgtctcaagcgctttcttttgggctgcggacggctgcctgcctgtcagcatatacaaatagttttcaacgtgtccgtatcgcgcctcgggtgacagcgcttcctgcccttgtttacggcggtatctgtacgcaataatcgtcggtgtgacggcaatcagtttaatcgcttcttccggcttgggcggatatgtaaatgaatctgtgcccaaacctgaaacagccgttctcagcaccgccatgtcgtccatttcatccggaagcgtttccagtaagccgatcaaatgtttcggaagcccgcgctcggctgcaagttcttcctgaaacgcaagcaattgccgctcatcaggaagcgccccgttcaaaatgagatacgccgcttcttcaaaactgaattgcaatgcgatatccttcgcgtcatagccgcgatatattaaatgccccttttctccgtcaatgtggctgatcgccgtttctgcacaagtaatccctttcaatccacgataaatcaatttcattcccccttatcctctttctgttattatagtaaatataatatttaaaaaataatgaatatttttaagggaattaattaaaacttttaatcagaggagtgcatctatggattttaaatggcttcacaccttcgtcaccgcggcaaaatacgagaatttcagaaaaacggcggaaacgctttttttatctcagccgaccgtcaccgttcatataaaattattagagaaagaaatcagctgcaagctgtttcagcggagcggccggaaaatacaattgacggaagaaggaaaagcatacgtgccgtttgccatgagacttttggaagactatgaaaacagcatggcggagctgcacagggtgcgccagggctactcgcacacgctgacactcgctgtttcgccgcttatcgccgacaccgttctcccgtctgtcatgaagcgttatacagaggacaataaagaaaccgaaatgacggtcaccattttcgaatcggaagaaatcgcctctcaaatcagaaacggctcagccgatatcggactgagctgcttaaaggtgcaatcatcttccctcacttgcctccccctgtacaatgaccccgttgtcctcgtcgcgccacccggccgaaaacccgggacagggaaggcggatgaagtgaaagacctgttcggacaatatctgcttttgacccataaccatcctgactattgggatgatttgctccgccaggtcagaatacagttccctttcgtcaggacaatgaaggtgacacagacgcatattacgaaacgatttattaaagaggggctgggcgtctcatttctgccgctgtcagcggtacggtccgaactcgccgcaggcagcatgattgaaattccgtgcgaattcgcccagatgccgagcgcgggcgcgtacgccatcgccctctatgaaaatgaaaaaaagaaaacctttttagattttttatcacattttcatttttaggtgaaacaaatggagctctgccccgtctaaataaaaaacccgttcggatgaacgggtttctctcactgctagaatcttttcgcgcccaggtagcgcggtttccagtagctgttattcagatcacttgttgtgacgccgtcagaaccggcatggatgaacttgttgtttccgatgtatacacccatgtgtgaaggaccggcttgatatgttgtaaagaagacgaagtctcctcttgacgggctggatacgctcttcattgagctccagtatcccgcagtgcttgttctgccgacactcgtctgtttgtttaacaggtaccagataaatccgctgcagtcaaagccggaagtcgttgttccgccccatacatacggcgtgccgattaaagattgcgcatcagaaaccagcttgtttacattcaggctcgtctgtgcaatattatggctggatgaaggcttctttgatgacgaagatcctgaagacgctgaaccggaagttgatccttttactttaagcacttgtccgatgcggatcaggtccgtttttaaaccgtttaaactttttaattggtttaccgtcattttatatttattcgcaattttccaaaggctgtcgccttttacgactttatatgtagacgatgatgacttgctgcccgaatttgaacctgaagatgatttaccgttgatcgaaagcgtctgaccgatgtaaatgatatccgattttaatttgttctcagatttaatggaattaattgacgttccataccgatttgaaagtccccataatgtatcgcctttttttaccttaatcgtttgcgcagacgccgcgcccgcaaacaaagtcgtccccaaaaccactgccgttgttgctgtaacaagttgctttttcatattttcctccctgaatgattctatctattttatgtgtctcttttttaaagtttttatctgtttcctattataaggttcaatttccactagaaatagacttgacttcccgtgacaaatttcttactaattcgtttttgaaaaaagtttttaagggtattaaatatttcaatttgatttcaaacgtgacgaaaaacgagtcaatttgtcatgtttttttcctgtgatcctcgtattttggaaaaacaaagcagtttactttccaaataactccttgttaaaaaaatcctcgtctttttcaaaaaagtgaatggttttcactctttcttgaaaacataagttacaccggaatttacatttctaacaatgtttcacctgaaatttacaggaggaacaggcgctctttacaaacaccccctaccattagacatgcagacacgattaaaggaggacgagtgagaatgagtctatttaaacaggttcgatcaaaacttctgccggcggcagccgtatccgtgctgacagccggtctgattgcgggcgcggggtttcagcactctgaacaggctgcggcaaaaaaacagcctgacaaaaacgagatcagaaacgtcatcttcatggtcggcgacggaatgggcgcaccctatatgaacgcctaccgttcggtcattaacaaaggaaagccttcggatggtatgaaactgacggcattcgaccccaatctcgccggtatgatgatgacttatcctgacgatcctgattccaatattaccgattccgcggcggctggcacggcaatggccacgggcgtgaaaacgtataacgcggcgatcggagtcgataaaaaaggaaagcgggtcaaatccgtcctcgaagaagcgaaacaaagagggaaatccaccggacttgtcgcaacttcggagattgcccacgccacccctgcggcattcggagcccataacaaatcccgaaagaacatggatgagatcgcaagcagctactttgatgaccgcatcaacggaaaacaaaaagtcgatgtgctcctcggaggcggcaaatcaaactttatccgtaaagaccgcaatgtaacaaaggatttcaaaaaagcgggatacagctacgtgacatcaaaacaggagctgaaaaaggaccgtaacaagaagattctcggcctgtttgccgatggcggactcgacaaagcaatcgaccggtcaaacgctgtcccttcattagaagacatgacaacggcggcgatcgacaggctgaacaaaaataaaaaagggttcttcttaatggtcgaaggaagccaaatagactgggcgggacatgacaatgatatagtcggcgcaatgagtgaaatgaaggattttgaaaaagcgtataaagcagcgatcgcatttgccaaaaaggacaaacatacgcttgtcgttgccacggctgatcataccaccggcggattgacgatcggcgcgaatgacgataaaaactggcatgttgaaccgattcttgccgccaaaaaaaccccggcatttatggctgaccaaatcaaagcgggcaaatccgtatcttccgtgcttgcgcgttatacagacctgaaatggtcaaaagcggaaattaaacagatcgaaacggccgcaaaacaggatgctgacaagagcgtctacaaagcgatcattaagctttttaatgcgaaaacaaacagcggctggacaaccggcgatcatacgggcgaagaagttcccgtttacgcatacggtccgggaagagagtcatttacggggcttttaaacaacacggaccaggccaaaaagatctttcacatcctgaaacacggaaaataaaaaaggatgcggggatttccccgcatcctttcttcttttacaaatatctccggtgcactcctttgccgtcatacgaaaacatcacttctctgtcttcaagaacagattcgatgtgcacgctcctgccccacagctggtacagatacggcagcactttctccaaatatttcagatcaagctcaattccctcataccaatgtttaatataaagctcattattcttcaggtaatccccgtcattgacggtcagataaggaaatcccccgttgacccgcatgttcacgagctggtcgcgcacggccttccattctttgtcgatcactttatagtccctgccctgcttttggaataaatacaaatcctcacgcataacgagatctttcgtcaaataattgcggataaatgatatgtccgattcaatttccctgacctcaaacattttctcgcggccggaaccgggctttacccctgtttttttcatttcatctgtcgggttgtcataacgctcttcgatgtcttcaaaaattttcagccctaaataatacgggttgattcccgtttttgacggctgaacgacgcctgcgttcagcttcgcaaattcgatggcttcatctgaagtcaggtcaagctcgcggataatccgctgatgccaataggatgcccagccttcgttcatgattttcgtttccagctgaggccagaaatacagcatttcttctctcatcatggttaaaatgtcacgctgccacggttcaagctcccgcgaatgttcctcgataaacagcagaatatctttttccggacggggcggaaacggttttttccctcttttctttttcacctgtttcggcttatccattccccataaatcatcgtaaggcgatggcgcggtttcttcttcgtcctcctcttcgtcatcgacgctccacagcagcttcggcctgacgagcgacggatcgatatgctcctgaatcgccagaatggcatctaaaaaggactccacctcttttatcccgtgaattctttcataatgcttaatccgctccgccgcagccgccatactctcaaccatgtcccggttcgtattttgaaagcggcagttatttttgaaaaaatcacaatgggcaagaacatgggctacaattaatttattttggatcagcgaattgctgtccagcaaaaaagcgtagcaagggttggaattaatgacaagttcataaattttgctcaaaccgagatcataatggagtttcatcttatgaaattgtttgccgaaactccagtggctgaatctcgtcggcatgccgtacgcgccgaatgtataaataatttcagccgggcaaatttcatatctcatcgggtagaaatcaaggccgaaaccctttgcaatgtcggttatttcctcaattgcccgctgtaaaccttttgtctcctccgcgttcaagcgaatcccccctacttggacttatttataatgtatgacccctcctctcaaaagatgaaataacagaccggtttccgactgaaaactttcggcacatccgccctgtttgctttatatgtaagtgggtaaaacacacaccataccccaaaaagaaaaggagcgattctacttgaatacagcagacatgcttacgacgtatctcagcaaactcccgaatctgatcattgcactgctcgtcctgcttatcggctggggcattgccaaaatcattgaaaaagccgtatacaaaggcctgcaaaaaacaaaaatcgacgacaggctgttcgccgaaaaaaagccggcgcgctattcctcagaaaaagtcatcagtaaagtcatttattttatcgcattaatcatcgtttttattctattctttaacattctgcatctgacaaccgtggcttcgccttttgtcagcatgctgtcggcgataacggcggctgtgccgagcgttttaaaagccggcttgattctgctcgtgggctgggcggccgcttcgcttttcagctatctcgtcaaaaaagcgggcatgaaactcgctgaaaacggccggctcagaaaatggacaatggtgtctgaagaagcggagatgagcagatccgttacggccgcttcacgaatcgttttttacttcgtcttgctcttgttcctgcccggcgtcttgtccgctctccagatcagcggagtgtcagggccgtttacaaatatgattcaaagcgttttgtcctttataccgaaattattcgccgcggcgctgattgttttaatcggctggcttgttgcccgtctcgtccgtgatatcgtcacaaactttctggcgagtatcggaacggaaaggctcgccgcacgtatggggctttctatttatctgaaggatacgagcctgtcggcaatcatcggaacgattgtctacgtgctgattttcattccggtgatcatctctgcgcttgaccggcttgatgtggcgggtatttctgaaccggcgtcagccatgctgcacacggtcttcacaatgctccctaatatcatcatcggtattgtgctgatcatcgccggcatctgggtcggaaaatgggtcagcagcattgtatccgggctcctgcaccgggccggtttcgactctcttctcggtaaaatgggctttgaacaggcgggcaccccgaagctgacgctttctcagacggtcggcatgattgttcagatcatcatcgtcctgctctttacggcagaggcgctgcagcttgttcatctcgaatttctcgtcgttatcgcaaccggtattatcgcttacctgcctaatgttctggccgctgtatttattctcggaatcggacttttggccggacagcttgtcagcaggctgcttgccggcatgctgagcggaaaggaattcagattcctggcgccgcttgcgaaatataccattatcactctctcaatctttatggcgctggatcagctcggtgtcgccgacacgatcgtaaatgccgcgtttattctgattctgggcggtttcgcgcttgccttcggactttcattcggtcttggcggaaaagaatttgcctcccgttatctcgcaaaattggatcgcaaaattgaaaaacatcaatcggctgacgatcgtaagccgccgatgtcttaacgaaaaaaacgtgtgctcagaaggagcgcacgttttttttgagttaagggggcaaattccttttttttcattttagattcatatatgatagactgtaacagaagcaaaatctcttttttcgaggtcattctatgaaattaacgaactataccgattactctttacgcgttttgatttttttggcttccagacattccgacgaactttccaacataaaagaaatcgcagatacttattccatctctaaaaaccacctcatgaaagtcatttaccgtctcggccagctcggatatgtcgaaacgatccggggccggggaggcggaattcgattaggaatgacaccggaagacataaacattggagaagtcgttcgacatacagaagacgactttaacatcgtagaatgctttgactccaaaaaaaatctctgtatcatatctcccgcctgcaacttaaagaaccttctgaatgaagccctgcaagcttacctggccgttttagacaaatatacgttaagggatctggtcaaaaacaaagaggagattatgagactgctcagaagctgaaggaatgtccgcattccttctttttttatgccggcataagaaaaaaggactatttctattaatatgataaacgattgcagacaagtgccgatataaagattatcattactgatatcctcaccttgcggctgcaacgaatggggatagaaaaattatcgcaggaaaagggagattcactatgaaaaaaaaggtagcggtcggtttgactgcatctgcgatcgtcgggtctgcgttagctgtaacaccggcagaagcacaaacgattaaggtcaaaagcggagattcattatggaagcttgcccaaaactacaatacaagcgtggatgccattacatcagcgaatcatctaaaatccaccgttctttctatcgggcagacgctcaacattcctaacggcaaatcagattccggcagcaaaaagccatcttcaaagaacagcggcacgactaaaagcgtctatacagtgaaaagcggagactcgctgtggctgatcgcatctgattttaaaatgtccgtacaggaactgaaaaaattgaacggtctgacaagcgacttaatccgcgccggacagaagctgcaagtgacggggaaagtttcctcaagcaccgatcagaaaaaaaccgctcctggcagcagctcaaacagcagcaaaaagcagtcatcatcttccgggacctataaagtaaaactcggcgattcactatggaaaatcgcaaacagcgtcaatatgaccattgcggaactcaaagtattaaacaacttaaaaacggatacgatctacgtaaaccaagtcctgaaaacaaaaggaacgtcttcttcgggaaacacgccgtcaaaagacaattcaaaccaaaatcaaaaccagacgcaaacgtcctcctatacagtaaaaagcggagactcactctggaaaatcgcaaacgcatacaatatgacggttcagcaaatcagaagcatcaacaaactgacgtcagacatgctgcgggtcggacaagtgctgaagctgaccaaaacgtcttcttccggctcttcgtcttcaccgtcagctccgaaccagtccggaaatacagggaaaaccactacatataccgtgaaaagcggggattctttatgggtgatcgcccaaaagttcaatgtgacagcccagcagatccgcgagaaaaacaatctgaaaacagatgttcttcaaatcggacagaaactgacgattaccgggcagcagacaaacacgacaccgaatcagtccggcagcacaggcggcacaggttcaacaagcgcgaagattaatgtaatgatcgatgccgcaaaagctcagctgggcgtaccgtatgtatggggcggaacgacgccgagaggctttgactgcagcggtttcatttattacgttctcaataaggtcacttctgtatccagactttcagccgcaggctactggaatacaatgacatcagtcagccagccggcggtcggtgactttgtctttttctcaacttataaagccggaccttcccacgtcggtatttatctcgggaacggccagtttattaatgccaacgattcgggagtcgttatttccagcatgaacaattcctattggaaacagcgctacctcggcgcaaaacgtttcttctgatacctgataagctgtacggccgcataaggctgtgcagcttttttacagtctgaaaatattgatgctgatcacgtgttttgttacgggatggaaatacacttcagcacgggatgaaaacgtttcttttgcggtttgcaccgttacgcgaaacacgtctttcgtctgttcccggttcacttttgtacggcccatgtacgaataatcggtaagctcggcccccttgtattcacgttcaagctggttccatgcgagctgttcccatttttcaactgacggatcgaggtgttctgtatgccctttttcagcgatagaggcaatgagaatgccgcaaaacaagagggcaagcgcaaatggaagggatttcatctttatgttctcctgagtcgttttttgtcaatcttagcgtgtccaaagaagagacggatatgcggttttattttatgtctccctcatattgctatgccgcagtgataaggacaccaagttttcccccgttgcatccgggcttcggcggcataaactaacggagaacttctcattgaaaggagaagcgtaagatggatcatgccgattatgataaagccttgtattacacacaccggtctcaatgggacaatttattaattttgatggttcgtacaaaagatgatttattatcaaagcgtattgagcactttctacacgcgtatcatttcgaatatgatcatgccgtgcttgaaaaagagctgtattcccttctcgggtatattgatcatgcgacagagctcgcttatgaagatcaattagccatgctgacataaaacaatcccggcgtcagacgccgggatttcttgtgtttgtgaacatattcagctcttcgatcatgtctttcaggctgaccgccatatcctcagatacggtccggcgctccatgtcgatgtgaatcgggtctaagaccagctgtttcgggatgacatttgcatagacgccccgcatgaccgtccgcatattcgccagcgcattcatgcctccttttcctccgcccgccgcggcaatgacggccaccggtttgtatgcccagtgatcgctgcttaaaaaatcgatggcgttttttaaagcgccgctcatgccgctgtgatactcgggagataataagacgacggccgctgactttttcacctgccgccttaacttttgcactgaaggcagctcgttctgttcttcttcaccgttataaagcggcagttcactttcgctcaaatcaataaaatcggtatgaaaccgatctctgatataagaagcggcaattctcgtccgcccgttttttctcggtgtgccgctgatcactaatatgctcatgattttaccgcctttcccaaaacattatattttaccgcatacaatgccgcctgcgtccgatcggaaagattcagctttgacagcaggttggacacgtgggtcttcactgttttttctgaaataaacagggccgccgcaatttccttattgctttttcctttggctatttcttgaagaacatctttttcacgggggatcagctgataatatttttccttatcctgatcatcctgaaccatatgggtcagcacgtgaggcacaatatccgaacttccggccgccgtcctcaagcggtacggtcgcatgatgggtaatgccctccgtatcgcggcagttcgtcgtctgttccgcaaattcaatccgtttgcaattcattatgtttacggcctttgtcaatccgccattgctgaatttggtcagacaatagcattccccgctgcacatgagtgcattttcccgctgaccgagagcaggcggtaaataagcggatgcggcgagcgtataagacccgtccggctcaatcagaaaaatccaccctgtctgcagtccggtcaggctgagcagttcgcggagcactttatcaagcgcttcctttaaatcgtggttttggtttaaggtttccgcaatcgcttttaacgtttttaacgtttctaccgtcgttttcgtcaatttccctcactccggccaatcagaattatccatattatatcaattcttttctgtatattcctttgttttcagcatgaattttcctcatactttcggatgaggcgtataaaaaaaccgccggatgtcgcttccggcggtttgttgtttatttcgttttttccactatgccatccaccgttttcatgacggcttcagataatgcggcaagacgctgttcgctgtcttgtaaagaagtccccttcacggcgaaatagaacttcactttcggctccgttcctgatgggcgaaggcagaaccaagagccgtcttcaaggaaatatttcaggacatttgacttcggcagatcaatatcttcttcaagatgatcggcaaatacagtccgttttcccgttgaatagtcttcagcctgcgtgatttgttttccggccatctgcttcggcggatcgtttcggaatgaagtcaggatagcggaaatctgctctgctccctgtttcccttttaacgtcaatgacttcaagccttcacggtaatatccgtattctttaaaaatggacagcagcgcgtcataaagcgacatgccctgctttttataaaaggcgcatacctcgacggctaacagcgcagcctggatcgcgtctttgtcacgcgcgaaatcgccgattaagtagccgtagctttcttcatacccgaactggaacgtgtattggcctgatttttcatattctttgatcttttcaccgataaatttgaagcctgtcagcgtgtcaaccgtatctaatccgaacgatgaagcgacagcgcggcccaattcgctcgtgacaatcgttttcatgacgacaccgttttcaggaagggtgccctgttttttcttctcggaaagcaggtaatgcaataaaagcgcgcctgtctggtttcccgtcagcactgtgtacttgccttcgctgttttttacggcaatgccgagacggtcggcatccgggtccgtagcgacgagaatatcggcattttgttcttctccgagcttaatggcatattcgaatgccgcgtgctcttccggattcggcgatttgacggttgaaaaatccgggtccggcagctcttgctcctttacgacggtgacgtttttgtaaccgagtgcttcaagaccgcggcgcaccggtttatttgccgtgccgtgcagcggagtgaacacgacgctgacatccacttcatccgaaagctcgggatgtacggagatggaagtcagtttttcagtatacggtttatcaatttcttcaccgattattttaatcaaacctttttctttcagcgactgttcatcttcaacttgaatcgttaattcattttctatggcattcacttccgcaatgacgatgtccgcttctttcggcggcagctgtgcgccgtcatcgccatacactttatatccgttatattcaggcgggttatggctggccgtcacgacgatgccggcataagcgttcagctttctcaccgcaaaagacagctcaggcgtcgggcggagctcatcaaagacgtatgtttgaatgccttgggaagcaagggtttttgcagcttccatcgcaaactcaggagatttatgacgggagtcgtatgcgatcgcaacccctctttttttcgcgtcttccccctgtttcgcgatatacgccgcaagtccggcggatgctttgcggaccgtgtaaatgttcattctgttcgtacccggcccgatttctcctctcatgcctcctgttccgaactcaagatttttgtagaaaaaatcttccagcagctgctcgtttccttctgcgtccgccaataattttttcaattctgaatctaattgttcggcctgattccagcgttcgtaactcttactccaactcatgttcgtcctcctataatttcagcttatgaccatattttaatatgaagcggctgcccgtgtcacttgataacttaaccaaatgctttatgtaaaaagataaaagaagggctcatgccttttcggcacagccctccggttattattgttcgagcggaacaaccgcgtcgtgcagcagcgtatttaaccactcagtgtgtttttctttcgtttcgtcattccattggaatcggtcgctcatgtaatcaatcacggccgttttatacgtttgcacccatttgatgtcgaagaacagtcttcccgttctgcggacgaagaaatcggcaggtgtcgcagccatttcttcttcgatgctgtaagccgcttccgccagaatgtgaaccggaatctcgcgtttttccgcttcatctttcaggccttcaatccggctgaatacattttcaacgttagagccgtatctgatggctaactgcttagcggtttcctgtgataaaccgattttcaagccgtcttttgtctttgcttccacaaatgactcgaagtttttagagccgccgacatgtccgccggaaatcggcatcgtcttcgtcttgcagccgccgaagtcctggccgccctcttctttcaagcggtcgcggacaagatcgacaatgtgctcagccattttacggtagcccgtcagttttcctccggcgatcgtaatcaggcctgattgagatgtccagatttcatctttacgggagatctcagacgggtctttcccttcttcgtgaataagcggtctgaggccggcccagcttgattcaatatcgtccgccgtaatgttcagttccgggaacatataattgatggagctgacgacataatcgcgatcctgcaccgtcatgcgcgggtgctcaagtttttgtttgtaaaccgtatcggtcgtacccacgtatgtttttccttcacgcggaatggcgaacaccatccggccgtccggcgtatcaaagtacaccgcctgtttaagcgggaatacggattggtcgaatacgagatggaccccttttgtgtgctggagatgttttccgcttttgctgtggtctttttctctcagttcgtcgacccacggacctgtcgcattgacgatttttttggcgtacactttgtattccttgcctgacagcagatcttcaattaaaacgccgacaacttttcctttttcataaagcagttctttcactttagaatagttgacaggctcagcaccgaatttaacggcttctttcatgacttcaatcgtcagtctcgcatcgtccgtccggtactctacataatagcctccgccttttaagccgtcttttttgacgagcggctctttttgcagcgtttctttagcagacagcatgcttctgcgctctgatttttttactcccgctaaatagtcatacacacgcaggccgattgaagtagagaatgaaccgaacgtgccgcctttatgaaacggcagcagcatccattccggcgtcgtgacgtgcgggccgttttcgtacacgatggcgcgttccttaccgacttcagccaccattttgacttcaaattgcttcagataacgcaaaccgccgtggacaagctttgtggatcggcttgatgtgccggccgcgaaatcctgcatttcgctcaaagcgactttcattccccttgaagcagcgtcaagcgccgtaccggcacccgtaatacctccgcctataataaacagatcgtatgtttttttagtcatgtcttccagcatatgatcccgttccaaacttgaaaattggtgattcatcattacgcttcctccttgttgtcacggtatagaaaaagagaccacaacagccaaagcgcatgtcatcactttggtgctgtggtctctcctcatctcaggaccgttcctattaacttgttttcagtataccataattttatcttatttaaaagccatagctgcatttactgcttttttccatccgccgtacaattcaacgcgtttttcatcttccatttccggtttgaattgcttatcaaggttccactgatcggcgatttcagtgctgtccttccagtagccgacagcgattccggctaaatacgcggcaccgagcgcagtcgtttcattaatttccggacgttcgaccggcacatcaagcaagtcgctctggaactgcatgaggaagttattttttaccgctccgccgtctacacgcaatgtttttaaagagatgcctgaatcagcctccatggcatcaagcacatctttcgcctgatatgcgagagattcaagcgtggcacggataaaatgctccttcgtcgttccgcgtgtcaggccgaaaactgagccgcgcacgtcactgtcccagtacggtgtgcccaatccgacgaaagcgggcacgacataaacaccgtcagcggaatccacacgctctgcgtatgtctcgctttctttcgaatcctggaacatccgcatgccgtctctcagccattggatggcagaacctgcgacaaagatgcttccttccagcgcatactcgacttttccgtctaatccccaggcgattgtcgtcagaaggccgtgatcagaagtgatggctttttctccggtattcatcagcataaagcagcctgtgccgtatgtgtttttccccatgccttcttcaaagcacgcctgaccgaacagcgcagactgctggtctccggccgctcccgcaatcggaatatttttaccgaagaaatgataatcaaccgttttcgcgtacacatgagaagacggtttcacttccggcagcatggatttcggcacgcctaaaatatcaagcagctcgtcatcccattttaattcatgaatattaaacatcagcgttcttgaagcgttggaataatccgttacgtgcgccgcgcctccggacattttccagatgagccatgaatcaatcgttccgaacagaagatttccgttttccgctttttcccgcgcgccttctacattgtcaagaatccatttgactttcgttcctgagaaataagggtcgatcaaaagtcccgttttttctctgaatgtatcattatatcctttttcacgaagctcttcgcaaatgccggatgtttgtctcgattgccacacaatcgcattgtataccggctttccggtatctttatcccatacgaccgtcgtttccctttggttcgtgatgccgatgccggcaatttgatcagcgctgattccggactcggaaatcacagtcgcgataacggcgagcaccgatccccagatttcgttcgcattgtgctccacccagcccggctgagggaaatgctgtgtgaattccttttgagcggaatgcacgatttttccttctttattaaaaagaatcgctcttgaacttgttgtgccttggtcaattgataaaatataggtctccatgatgccgctctcctttttaaatatattcagaatttgataatgttttctgtgattgagatttcttggtataaatatagagtatgaaaagcactacaaccattataacgcttacaaaccaaaagctaggtgtcacatttcctttaaacgcggcattgtaaaatacgccgccgaacgcaccgcccatgatcggaccgattacgggaatccaggcatatttccaatttgacggcccttttttcgggatcggcagaaaggcgtgagcgattctcggccccaaatcccgcgcagggttgatcgcatatccggtcgtccctccaagagaaatcccgatggcaacgatgaggaatccgacaatcagcgggttcagcccttttgtaaattcattcgctccgattgccaaaatgccgagcacaagcacaaacgtaccaatgacttcacttatcatattcccaaatgtatggggaatactcgggccggtcgagaaaacgcccagtttagcggccggatcatccgtcgccttccaatgcggcagataatgaaggtacacaacaaccgcaccgatcattgctccgatcatctgtcccgcaatataaacagggacgtctttccaaggaaagctgccttcaagcgcaaggcctatcgttaaagccggattcaagtgagcgccgctgatgctgccgacggcatatgccgccatggctactcccaatccccagccgaatacaataacaatccatccggattggtatgaaagcgatttctttaagttgactcccgcacaaacgccgccgccgaaaataacaagcagcattgtaccgattacttctccccaaaatgctgtcatcatcattcctcctaaatgacaaaatagcaggtttgacagagttatagagaataaaaaacccacaacaaaccgctttacgctttattgcttccgtaaagagctgttgtgggtctccgggtctccatcacatagtattaacctaggtctattgtaacaatgggtgtaagcggtgtcaatctttttttgtcatagaatgttcatatttagcccatagttcggtgtctgaagtcgtcacggccgtggctcctgcctgcaaggcgttttcaacgtcctgctccgtgcggatgaagccgccggcaaaaatcggaatccccgtcatttctttaatttctctgattaaagtcggaacgatgcccgggagaacctcgataaagtcaggcttatgctttccgacgaattccatgcttttttccatggcgctcgtatccaagagaaacagacgctggatcgcgtatattttcttttgtttcgctttgacgatgacggcggatctcgtcgaaatgatgcccgcgggccggatgtcctgacaaatgaactccgcaccgtattcgtcatgcttaatgccgtgaattaaatcgacgtgaaccatcagaagttttccgtgttttttcgcttcattcacgacaccttttaattgaccgaggtgtatatctaaaatgacgccgtataagaacggactctctaaaaatgcatcgaattgcttcatgttccggatagccggtagaatcttctggttgtgaaaactcatgttttactcctttactttaaaaatcaatgctcagcacgctttccttgacggtcgaaatgatgaaagagagctcctcgtcggacaggcaaaaaggcggtgacagctgaatgacattattatatcccgctacagtatcaccatttttcccgacaagcaggcctttttctctgcacgcggtgatgacgtgctgcacaagagcggcatcagcgggttccttcgtgattttgtccttgacgagctcaatgccggcaagaaggcctttgccccgtacatcgccgaccgccggatgttctttgagcggctcaagctcacggagcagccgttctccaagctcccgggagcgggcgatcagattttcgtcctccatcaattgcaggtttttcaaagcaagggcgcaggctgccggattgcctccgaatgtattcacgtgccggaagcggccgtacggctcaccgcccgaatacgcctcaaaaatctcccgttttactgccgttgccgacagcggcagataagcgctcgtaatgccttttgccattgtgacgatgtccggtgaaacgccgtaatgctgaaatccgaacggctctcccgtgcggccgaaaccgcaaatgacttcatcactgatcagaagcgcgccgtggcggcggcaaatgtcctctacctttgccatatacccgtccgggggcatcagtatccctccgcctgtaataatcggttccataataacgccggcaatcgtttcgcttaactcccacgtcatgatccggtcgatttcatgcgcgctttccaatgtgacggcatcgccgggattccgataaagatcaggcggcgccgcgtgcaaaaaaccttgtgagagcggctcatatttatattttctctgcgcctggccggtagcggcgagcgcccccatcgtattgccgtgatagcctctgtaccgggagatgaatttgaagcggctgtgatcgccgttttcaatgtggtattggcgggcaattttgaacgcggtttcatttgcttccgatccgctgttggaaaagaagattacataatcgccgccgagccattcattcagtttttccgcaagctcaatcgcgggttgatggctttgggtcagcggataataaggaagctccttcaattggctgtaagccgcatcggcaagctcctttctcccgtatccgatattgacgcaccacaatcctgacatgccgtccaaataccgtctgccgtcaatgtccgtaacccaggcgccttcccctttttggacgattatgctgtcatccggctccgcccctttcatcgcgtgccaaatcagctctttatccttttgtttgagtgactgatttttttgtacatgttccacaccgctcatctccctttcaatatcattgcactgtatcgaaagctgcccggcttctgacgccgattctcatggtgaagttttcctcttaataagaatataaaggcgcggcatgggcgagtcaataaagcggcggcaattaaaaaaacgctttctcccagaaagcgaaagggctacaagagcatatcccgaaaccggggccggtgcaagtgtttttataaaaaaacccgcccttaagcggggcgggcgtttttttatttcagatgcgtaatccggtaaatgtctttgcgccggtctttcagctggcgcacggttccgttttcacgctgccttcttaagatttcaaggtccacgtccccgatcacgaccatttcgatattcggattcgtttcaccgacgattccgtctctggcgaattcaaaatcagacggagcaaaaatggctgactgcgcgtattgaatatccatattttctgtttgcggcaggtttccgaccgtacctgagatgacggtgtaaatttggttttcaaccgctctcgcctgagagcagtaccttacgcgcaaatagccttggcggtcttcagtgcagaatggcgtaaagataattttcgccccttgatccgcggcaattctcgcaagctccggaaattcgatatcgtaacagatctgaatggcgatctttccgcagtccgtatcaaatacgcgcaccctgtctccggcgctgatgccccaccatttccgctcattcggcgtaatgtgaagcttatattgtttttcaatcgtgccgtcacgtctgaataagtaggcgatgttataaattttcccctcttcttcaacgaagtgggagccgccgataatgttcacattatatttcaccgcgagatctgtaaagaggctgatatagtcctcggtatattcggtaatcctctgaatggccagactcggagaacgctcttcgagaaatgacataagctgcgtcgtgaaaatctccgggaataccgcgaaatcagatctcgcatctgaagccacatcgacataatattcaacctgattggcaaattcctcgaaagaataaatctttttcatttcatattgaatgacgcagatgcgcaccggaaatgccgatttgtaatagcgctttgactgcggcagataatcgacattgttccattccattaatgtcgcatatttaatggacgcggtgtcatccgggagataattcggattgatccgcatgagcgtaaatccgttcatcagctggaaagaaagcaccgggtcataaatctgatggcgcgtcacctgttcgacataggctctcgccgtcatttcttccgcatacttatgataattcggaatccgcccgccgataatgatgcttttcagattcaatcgtctcgccaagtcttttctcgcctcatacagccggtgtccgattttcatccgcctgtattccgggtgaaccattacctcaatcccgtacagattcaatccgtccgggttgtggttcgtgatataaccgtcgtctgtaatgtcctgccacgtgtggcggtcatcatattcatcgaaattgatgatcaggcttgagcatgaaccgataatttccccttcatactcggcgcaaaactgaccttccggaaagtgcgcgagatggctgattaaatgctcaggctcccacggctccatccccggaaaacaatccttttgcagctcaataattttgttgatatctttctcttccatattccgtatgaccattttcttttcaaaacgggtcagatcaagtttctcagacaatgctgcttccccctgccggttcgttttgatcgttcaatcgctgtaagagtaattcaagttccatttccgccatcgattccagtctgtgatcgtattcttcaaataacagggcgctcgttaccttattcggcacgatgacacatttcatgccggcgcgtttggctgcgattgagccgttgaccgaatcctcaaaggcaagacattcagaaggttcaacgcctaaatgttccgcagctttcagatagagcttcggattgggcttcacttcttctacgtcgtcagccgtctgaatcacttcaaattcatcaaacaggcctaattccttcagatggcccgacacccatttaaaatctgagctggaagcgagccccaccttcaatcctaattcttttgccgcggctaaataagcctccactccgggacgcgccgtttccgtcttcatccgctgttcgaagcgcccgcgcctgatcgccgtcagttcatcatgatcgagctttcttcccagctgctcctctaaatatgcgaacggcttaaaccccgccgccgttccgatcacctttccccagacggataaaggcaatgttgaaccgtgttcctcaaacatttcctgcagcacttcatattcatgggtttctgtatctaaaattaacccgtcaaaatcaaagattaatgcttttatcaatggttacagctcctttagctaaacgtactgacctatgtatacactataccgtgaatttcttttgcattcaaaatgtaacattctcacggaaagaagagcctgcatgagtgcaagctctcttcatccgttactgtgtgttttgactggaaatattggaaagagccgctcccgcagactcatttgaacgctgatcgaccgctaagtctccaagcgcaacgatcccgaccagatgattttgatcgacaatgggaaggcggcggatttggtgttgggccatcagatgtgacgcctcttcaagactcatttccgggtttccggatacaacttgagaagacatcacgtgtgaaacaggtgtttggccgtcgcggccttgagccgttgttctcaatgcgatatcacggtctgtcagcattccttttaattcccctccgtcaacgacgggaattgctccgacattatgctggtgcatcagcgcagccgcttcctggatcgtttggttgggagaaacggtagccacgtgggtagtcattgattgtttgattgaactcattgtaaagcacccctttcgcattttattatgctcggggatttgactcattataaagggagttagaggaaagaaattgtggtatcatgtcaaggaagcaaaaaagagcctgtcaaaaggctctttatacccgtcagatcagccttctgtgaccgcaggcttctgatccggcccctgtctcgaaatcatcataggtaaagggaaaattcattccgcattcattcagcaaagcgcaatttttatcaaacagcgcccgctctttgacgtcatatacggggtgcggctttgacagcatgatatgtaccgtttgcagacaagccataatttgaaacgcttcttttaaagttccttggtaacgttggttttgtaaagacaatacgcccctttttttaaagcgctgaatttccagttcggagaaataaagaggaaagacattttgaaacaattcagaggaaagctcttgtatcgcgctttcttgtccgtcagtcgctgcgttcacaattctcacatcaatcacctttcttgccatgtgaatatccttaatctttatcaagaatagcatagaaaaaaacgcgaaagctaaggtaagtgtttcctattgaaacagccgctttccgcttgaaaaggagctttatgatatgaaacaaaatgaccgcggtctggaactcctgattacggaaaaacacgccggacaatggctgttttcagtcctgaaatctgaattccaggcgtcaaaacccgtgataacggaatggatgaaccaaaaaagcattcaggtgaatcggacatccccgaaaaacaacatcatactgaaaaccggagaccgcttattcattgatcttcaggaaaaaacgggttcttcggtaattcctgaatacggagagccggacattttatttgaggacagtcatatgctgattgcaaataagccggcgggaatgccgactcatccaaatgaagagggtcagaccggaaccctcagcaacctgatcgcttaccattttcaaatcaacggcgaacaagcgaaagtgcgccacgttcaccgtcttgaccgtgacacgtcaggcgcggtcgttttcgcgaaacaccgcctggcccatgcaatccttgaccgtcagctcgaaaccaaaacattaaaacgcacctatatcgccgcggcggaaggaaaagtcacgccgaaaaaaggcacggttgactcgccgatcggccgcgacaggtcacattccgtcagacggcgcgtctcacccggcggacaagccgccgtcacccattacaaagtgaagggctatcatcccggtgcgcagcttacattggcagagcttgaactggaaaccgggagaacacatcaaatcagggtgcatatggcaagcatcggccatccgttggcgggcgatgacctgtacggcggaagcagggcgctgtttcacaggcaggcgcttcacgccaaaaaagtcagtgtcgtccatccgatctcaggagaagaaatcgttgccgaggcgccgatgccggctgatctggctcattttaccgaaacgtatttttcttaaaccgggtcggcatatataatatatcgtttcggcgcatttccaatgtaagaaaacggatagcaagtggtcaggatcagttcctcccgcttgtgttgaagggtgatgacagacgtatcatcccggctgacgatttttgtacggctgattttataagaaaacgtgccgtaagacaaaatcacgttcagtctgtctccttttttcagttcgccggtccggcggaacaccgtgtccctgtggccggataacacaatttggccgtgatcgccaggataatagctgtccttataatgtccgacgccttttgctaaatcatctgcgtcagtcccttcgacgatcgggagctcagcgtcaatttcagggatttctaaaatgccgcttgcctcacccgtttcggggtgaaattcttttttgcgctgtgcctgcacagcgctttttgtttcgttcttttccaagacaggttctgttgctttttttgcttcttcaagcgattggttcgttttcatatgtgaatcaatgatcttccagcttccgtaacatgtgatgataacacctgcgatgatgacgagaagcggaatatgtttcagtttgttcatcgtgtgcgggttccccttttctttctgaaaagccaatatacgccggcacccgtgatcaccaggccggccaatgccgtctgatggctgcccgctgaagtatcaggcaatgggcggcctttttgtgtgccgctttcagtctgttctgtgctttgttccgaatctgcggcagacgccgtacgggattcgggaattgactgcactgtatcagatgctgcttcttttacgacaggacgttcaggttttttggtttgatcaggctgttctgctgcatccggttttttagcgggtttttccgtttgaggtttttctcctttatcaggcccggtgctgcccggtgtttccccgcttcccggctgattgccggtgtcatcaggtgtttcggcggctgatgccgtgcggatgcggccgtcggtttgataagaaatcggtgcggaaaagcttttgacatagtctactgtcgcttccaaatcctcaggccccgtcaccggattcttgccgagtttcccgatcggaccgtattttgcccccgctgccgtcgccataaattgattgactgttactgtatatcctttttcgggctgtatgtctgtaccgtccgccattttcacatccgccgcttgtccggtttccgggttccatgtataggaaaatccgctgatgctgtaatccggtccgtacaccggagaaatttgcgcgttgatgatctcccgcaaatcttttcctttgatttcaagcttcgtcagcacattgccgaacggctgtacattataaagatctccccatgtgatcggccctttttttatgccgtcccggatgcctcccccattcataagcgcaaaatcggatttcatcttcgctttcataccgtcggcaatcagatttccgagcgccgtgtcgccgtcatttgaatacccgcccgttatatcatgggccgcttccccgaccgcttcgctgataatcggtttcactttctcttcatatttgcttaatatgcctgccgcatccggatcaggcttgattttactttgatcgatatattggatttccgctgattttttcacgatatccttcgactctttatctagttcgagatcggcgattccgattgcttttccgtattcaaatgcctgcacgatcagcttgccgttgatttctccgtttacgactttatgattgtgcgcggcgaaaatcacgtcaatctctgagtctgttccgcttgcaagctttgcggattctcccgtgatggctgagccattttgttcagcagacatatgggcgagcacggcgattgctttaattccttttttcttcaggtctgcggcggcgtcattgacggcctttacctcatccgtaaacgtaatatttttaattccgtccgggatgaccatgcctgccgccgatctggttacaaccccgataaatgcgaccggaattccggaaacgtatttgatttcatacggcggcagaaaggactcccctgacttcaatttacagttggcgcagacgagcgggaaatcttggccgtcataaccgcttgtccccttaccgtccggatgatctcctccattgatgatccgtttaagctcattcgttccttcatcgaattcgtgattgccgacagttccgacatcaaaaccgatgtcttccatcaattctactgtcggttcatcctgaaaaagggctgacacgggagagctgcccccgatcatatcgcccgcatgcacgacaaaggcgtgttctttctcggctttcgcctttttaatgtacgcggtggcgtagtccatccgtccgaaagtgccatccggtttaccgtctccgttaaggtcaagctcatattgctgatcaatttttccgtgcagatcattcatgctgatgattctgagcgggatacggccggagtcttcagtctgccgttctttatacgctttatccgttccagcttcattcagtgatccggcttgtccgattgcttccgcatctttcacgctgaacatcataaaacaaaccgtcagcaaacagcacgaaagacgcaaacccctttttttcttcattcatttcccccctgtcttctaagaaatacgttagcttattttcttaaaaatcacatcacttttttgtaaagattgtcttcgctggcgcaaaatagtaaataatccccacgtaacgaaataagtcttgatgtataacggatcggcttttttcacatcttaaatgtgatttgacatgaaggaggaaaacaaccagtggaacagcagcagaatcagcagcagccgccagtaaatcaggggattccgggttcaccgcaagtgaatcacggaggacatgagcttttcgatatgcatgaagtgctggccggaacagtcggcgttttggatcaatttatgatgctcagacagtttatacaggatcagcagctggccgacattcttgaccgccagtatcaattcattctcggactctataatctgacggcagaatgctttaagaccggccaaaagccttctcaggaaacgtcgacatatatgatggaggaacagaaccaggccgtctacggtataaaaccgactcagccgaaaaaaccgaatcaatcattaaatgatgtcaaagatctcggaataagcggccatatgctcggcctgattaaagctcaagcttctctcttgacgatgagctcgcttgaaatgaccaatcccgtcacaagaagagtgctctccgcccaaattcagcaatatgtcgaaatggcgtatgaaatcttcttataccaaaacaaacacggttattatcaggttcctcagctcaatgcacaagatatgcagaccatgctgaattcatttgcgccggcgcagggacagccgcaaatgcctccgattaaaggacaaatgggacagcagcagcaaaacctccattaatgaaaaaaacggcgttggaaagctgactctccaatgccgttttctttttttcatatgcttttgtgaaatcatgttcaaattgtttcaggctttctttcgtagctgcttcaaagcctttttcaaaatcctgtgtttcggcggttttattgataatggttaagataatgccttctccgaatgtttcggttaaatcctttatcatatagaaactttgcaaataaacatccgtttcatattccatacgcgatttctgccattttcggtcggtcgttaattgatcaaacggcacgacggaaaatgcaatcggatcaatgaccacatcataatgcgcaacccactcgctcagcccctcatgaaaccaaagcggaaatacagacgtatccgtccccaattgccgcgctttttgatgaaatgcgtagtgtgtatattcatgtataatcaattgcttatacatgaaaacggccagctcatcttttttcaaaagctgttttttctcttctggcaagagccccatcatctgctcctgctctgaataaaaaccgactacatttttcaatcctgagtattgctccatttcagcttcatccgaaaagaaaatgagttcaagaggcgccgctcctttatagccgacaatgatttggttgatacgctttgcgtggtccagcgtaagcttggtcagatccaagagcggcttttcatccgctgtatagtaaatcgctgtatgtttgtaaatttctttattcatgtgttcagtcacttgttccttcgtcggaacagagcggctgttttggcctgacaggacgtacatcatacttactgaaacggctgaactgacagccaatatgacaaggactccgcacaggatcagagtgaatgccgcccgtttccccatgccgtcacgcaaacaagctcccctccccgatcctttaattttcatctcattctttactttatgctcagaagcgctgggtcgtgacggcagataaaataaaaaagccgcagcaaatgcggcttttccattcatttatttattggggtttgggaatacacgctgcaccatttggccgaattcatcaaacagtccggataccgggtggccgttttggattcgttttccgtagccttgcatacgttcaacgaagtccgggtttgctgatacatatacagtccggacatgtttatcggctgatttcaccttatcggtaatcttatttttcaaatggttggcgatggcgcctttttgtccgtttgtcagaacaacggctacataagcgctgtttccggcaacgatcacagtcgcatttttaacttcttttaaatcagtcaccttgtctgcggctttatcagccactctcaggttacggttgtcattgtgatcggtgttttggttatgacggttcactgtattcatatttgtcgcaccgtcgttaggtgtgttgcggtaatttacattctgggtgcggttgtcatttcgttttccttctccctggttccccatactgcaccctgcggtaatcagcatcggcagaagaagggcagaaataactgcttgtttttttatcatgtgaattcctcctttctcactttacgtataggtttttctattcggcgggatttatgcacgccgtttgcattctgagcggtttggataaatatcagaaggatagggaaaggtaagcgtaatcaattgaatgaggagggatttaacttgttcagacaaaaaagcggcatcagcccgacagcgctgctgatcggatcatcgattctgattgcagctttatcacccgaaatccgccggaaaatctccggaatggtttcaggccgaatgcagcataaagatggtacacactccatgcagcctgctgacctgattcaacaggctttcagcggggaatccggcggacagcagcacacggacaaagcacggcattcacaaacaggctccatgcagcctgccgagctgatcaaacaggctttcggcggggaatccggcggacagcagcacacggacaaagcacggcattcacaaacaggctccgtgcagcctgccgagctgatcaaacaggctttcggcggggaatccggcggacagcagcatgagcagacttcccgcaatcactccggctcatcccatacggacggacaggcagaccgcagtaaagaaacttcgccgaagcctcactataccgagccgattcacttcgaagaaagcgcggtaaatgttttaaatgacagcaccgtgatgaatatgctggaagaaattgaacccggaaatcattagaaacgaaaaaaatccttcattcgttcaacgatgaaggatttttcgttttagcgctatctgcttttttattaagcttcttcagcttcaatgacgattgaggaatcattgtacaccgcggtatcggtttccttcgtcattttacttgttaacagccctgcggtcatactgccgctgacatttaaggcggtacgccccatgtcaattaacggctcaattgaaatgagcagcccggcaagcgcgacaggcatgttcaaagcggataggacgagcagagccgcaaatgtcgcgccgccccccacgcctgctacaccgaatgaactgattgccacgatggcgatgacggagatgataaatcccggttcaaacgggttttgccctactgtcggcgcaatcatcatcgcgagcatcgccgggtaaatgccggcacagccgttttggccgatcgataaaccgaatgaaccggcgaagttcgcaattccttcagggacgcccatgcttttttgcgttttaatattaagcggcaaagcccctgcgcttgaacgggacgtaaacgcaaacaccatgacaggaaatgcttttttcacgtatgtgatcggatttaaaccgctgaacgtaatcagcagcaggtgaacgataaacatgacgataagcgcggcgtatgaagcgatcacaaacatccccagtttcgcaatgctgtcgatgtcgcttgtcgcgatcgtctttgtcataatcgccaataccccgtaaggcgtcaatcttaaaattaacgtcacgacgcgcataataatcgcgtataccgcatcgacaattccgctgaacgtcgcagcgtgctccggctgcttccgtttcacgcccagaaaagcgatgccgaggaaagcggcgaaaataacgactccgatggtggaagtcggtctggctcccgtgaaatcaagaaacggatttcccggcagaagctcaacgatttgctgaggcagcgttttggccgtcatatcctcagatttttgctgcagctcctggcctcttgataactcggtgcttccctggtcgatatggacggctttcagatcaaaagaaagcgccgaaacaattccgactgccgcggcaattgctgtcgtggcgatcaaaattccgatgatcagtccgctgattttcccgatgttatgggtcagtttcagcttcgtaaatgcgccgagaatagaaataaagactagcggcatgacgatcatctgaagcaatttgacataaccgccgccggcgatattaaaccaatcggccgtttgtgtcacgatatgtgatgccggcccgtaaatcaattgcagtgcaaaaccgaatacaatgcctagtccgagcgcggtaaagacacgtttagaaaaggaaacgtgttttttttgcatgacaaacagacctgctataagcaaaagcataataaaaacatgtaagactacaaataaattctccaaaacaggtaaacactcccttgctcattatcctttaacactatattatatcaattccgatcggtcaagtaaggattgacaatatatgtatttttattgatttttctcttttctttccaccctttctctagtaacttatataagggtgattgttatgctgaaggaactgtttcttaatttaacgattttaatcacatttaattatctgttcacccttctttttaaagagtcgctttcgtataaagaagaccgtccgatgtttcaattactgaaggggacggtctgcgggcttttaggggtttttctgattgctttcggcttttcttactccgattccatcattgatctcagaaatatccccattatcatcgccgctctttacggaggctgggtgtctacggcagccgcctttgcgattatcgtcgcaggccgtatcctgatcaatttcaatgcaagcgccattttttccatcgccgccgtcggggttattgcgatactttctgcggccgtcctcagaggaaaaaagccggatcataaaatggcgttcgttatgctgcttttttcaaatgttattttcaccttgacgctgctgtttcttatgcctgaacagcctgccggggccctcgtttattattggctcatttccatcttgggcggaatgctgtcactgtatatcatcaaacacgaagccgatgcccgcgttttgttcaagcaatacaagtttcaagcgaattatgattttctgacggggatttttaataagagaaaattcgaggaagtctcgcgcgttctgtacgatcggacgtctcaatccccctcgtctcagctcgcgcttatttatttggatattgatcactttaagcagatcaatgatcaatacggccattatgaaggggaccaagtgctgaaggaactgggggcgcgcctgaggttcttactcagcagttctcatacgtcagcccgcatcggcggggaagaatttgccgtgcttatgcccaattgcacgtatacaaaagggcttcacctcgcagaggaaatcaggcacacgattgacgcgaacccgattctgctgacgagcggagatacaattcccgtgaccgtttccctcggcatcgcgcattatccgacaaatacaccggaccctcagacattgcccctgatcgcggaccggatgctgtacaaagcgaaaacatcagggcgcaatcaagtgtgcagcactgaaaaaaaagaatgatcgcccgaagaggaaatcattctttcttttcagtgagaaagccgcccctcaggaaaacgggaatcaggctgccctcatattctttttcaatcaacgccgcggtatcatctgattgatacaaagacaggagtttttgcatccgttcatcatctttatcctcagctctgacggcgatcagatgaatatacgcttccttcatttgcgccgatcggatcagcgcgtccttctccgcatgaaatcctgcttttttcgcctcgctttgactgagaactgctgcgtcagcatgttccgccgcctgataggcgttcttttttgtttccgtttttaaggtcagatgcttcgggttgtccttgatcatatccgttgaccccgtaccgctgaatccctttttcaatgtaatcagtccggcctcctgcatgagaaaaagcgccctgccgaaggccgccgcttcatcaggcacggcaatgaccgctccgtccggtatatccttcagccgtttatgttgcttggaatacacccccagcgatgccgcatatgtcgttcctaaaggggccagcttctttttcacgtgaggcggcaaagatttaaaattagtaacggattgaaacgcattggcgtcgagatccccgccggcaagtgccaaatcggcctcagcataatccgaaaacgttaccaaagaaagctgcaatccttcctcaccggcttttttcgcgacaaactcccagatcgattgatcagattcattgattccgatagtaatggtccggttcccgtcaggataatcgcatgaagtaagtgacatgatcaaaatgaaaagaaacagactgtttataagccgcagattcaagttgacctactccctatctatttttatgtacagaagctgcaccatggtattcgggctcatgattacatacaataccgattaaaaaaagggttgtcaattgcttccttaagaggctgcaaagcggtttttatcagctgcaaatgggctgttctggtctcaaatcagatttccgtatcagagcgttttcctcttaaaacatgttatttcgaaaaaagttacatttagcagttgttttttcttcggattactggtagagtaaaggtaattatttttgttcgaactatctttaagaagaaagttttgtaagagttttcgtcttggaagtttgttttagagcaagaatagtgaatttaagcgtttgtcgctttaggaggaaatttcatgttagaaggtaaagtaaaatggttcaactctgaaaaaggattcggattcatcgaagtagaaggtcaagacgatgtattcgttcacttctctgctattcaaggcgaaggcttcaaaactttagaagaaggccaatctgtttctttcgaaatcgttgaaggaaaccgcggaccacaagctgctaacgtaacaaaagcataaattgtttaaaaaaacctgccggtgtacgccggcaggtttttttcatctaaaacgaaaagctgttttgcaaaggcaaaacagcttttttatatcaggtggcaatatcccgttttaagaagacgccgaatgcaagcgccagaaaaataacgaagtaaatcacaagcatcacaaccgaaaatgtcatcgtcatcccctctactaaaggagtcccgttcatatattgcgacaaatccgtgttcgcaaataaaatatatttggtccattcaaatttcgcagcaagaaataccgtcgccgtgttccccataaccaatagaaaaatagaaaatccgaccgctaatgaactgttccggaataccgcagacagcataaacgccatcgtcgcaagcataaaagcggagacagattcatagacatatgttttagcgaggaaagcgatgatattttgctcaaaaacatggccgtctttgtatacgagatgaacatcagccgcagtatctccgcctgtaccgaaaaagaccaatcccaacagagcggagccggcaaataaaatcacaagcatcagcagtccgaacagcagcactgtcatatatttagaaagcaaaatctgaaaacggctgagcggacggatggccagcagcttgatcgtcccccagttgaactcattcgccacgatgcctgcggcaatgataatcgtaaacagcccggtcaaaacagtcatcatcgaagaatcagatacgtatgaccacactgtgtaccctgtatcctcggggatgttatgatccatacggtattgatttatcgcgacattctgtttcaggttatcaatgagcgtctgatttccggtttccttcatctgctgtttcatttctttgttttcagcctggagctcctgtttccaattcggattggcttcgttcgaggtgaaatggtttgacagaagcgcaaaaccgatcatcgaaacgcctaaaatcacaatcatagcccacgtgccgacgcggctgaaaattttaatccattcattatagatcagcttaaacatattgaacctcctctttcgtcccgccggtaatttccaagaaacggtcttccaaagattttgtcatgattttcacttcatataagcggatgttttcacggacgagcagtgatatcacatcaggcacttcctgtttggacagctggatctcaatgccgtttgtcttcttcacacagtcaaactgactcaaaacggcaagagcctcttctctttgttcaatatggaagaagtatgtatctttatcctcttttccttcatcccttactttttgaatatcgacaagctctcctttttgcagaatgccgattcgatcgcacattagctccatttctgacagaagatggcttgagacgatgacagccattcctttttcacgtgtcagctttttcagatggtccctgatttctctgatgccggcgggatcgaggccgtttgtcggctcatccagaatcagcaccttaggattatgcagcaggctttgggcgaggccgagacgctgtctcattccgagagagtaggtttttactttgtcatgtattctgtcctgcaacccgacgagctcgatgacctcatctattttttctttcgtaacgccttttaccatccttgcgtactgctgtaaatttttatagccgctcaggaatttgtacagctccgggttttccacgatggctccgacgtgcctgaccgcttttgcatagtttttcgtaatggattccccgcagattacgatgtctcccttagacagtttcattaatccgaccatcattctgatcgtagtggttttccccgctccgttcggccctaaaaatccaaacacttcgcccgcccggacggagaagctcagatcatgaataatcgttcgtccttttatcgttttctttacctgttgcagttctaataccgtttccaattagaatcccccttctatttcgtgcgcctgcatgacgtttctataccattgcagcacggacattccttcctgttcccgaatttcttcgacctcgcgccgttcagcgattttcccttttatgaaaaccatcacttcgtctaacagcgtctcaatctcgccgatctcatgcgtggcgatgacgacgatctgactgtcaaaatcaatataagatacgagactgttgacaatcgactccctgaccgccggatcaagacctgaaaacggctcatccagcagaatgaccgatgcttttctcgacagggccaaaacgattttcagcctgccccggctgcctttggacagctcttttaacttctgcttcgctgaaagattcatttccgctaataggttatgtgctttttccagctgaaaatccgggaattgcgaatgataaaacgtgagcatatcaccgacggtcgtccgggcggaaaacatatcatgttcggttaaataagccgtacgaaacagcatgttcctgcttactttgcactctcccatccggacggcgcccgatgtcggaaaagcaagccctgcaagcattttaagcgttgttgatttaccgcttccgttcggccctaaaattccgtagattttacccggagacaatgaaaatgatacatcgctgaccgcgatcctgcggccgtatttttttgttacgcgttcaaaatcaagattcatcgtttgcttcctccgcatattgtttgatcccctcgagcatttcctcaggagataaccccagctccgccatttcctgaataaagcgtttgaaaacgtcttttgtcagcctgtctttcagctctgctttcagatcggatctttccgctataaaggttccctgtcctcttctcgtctccacgatccccagcctttccatttcactgtacgttctttgtatcgtgttcggattcactttcatctgtacggccatctcccttacggacggcagtttgtcccccggtgaaagctcacttcggatcagccggtaatatatacgatcggcaatctgcagataaatgggcttggatgactgaaattcattctccatcattacacctcaacctttcgattcagcagtatagaggccagcgcgagacagagcgctgcaagcacgatcactgccagaaagctgaaaagcgaaatgtggacggctttcagctccatcgtccatccggacaatttcgtataatgaaaatgaaaattcgcatacacttttaccggccataaatcatgttgagatgaagtgaaaggcgtaatgattttatcgtcaatataggtccagacaaacgcaagcacgatgcagatcccccaacggaggacgggaaaatgttttaatgagtgaaaaacagtccaaaatacggccacgatcacagataagtacgctgaactgatcagcaggtaagcattcagcccggttaatgtgccggccaggggaatggtgtgttccagcactccttttgcagaaagcatccggtacatccaaatgccgtaacccgtcagcgccagctgcccgatcaactgatacagcagtgaggccgtcagcttggaagccagcagataaaatcccccattcggattgtaaagccacagctggttttttccttctttatgaaggtgataatacataaaaagcggcgctacaagaaattgaaaaaaccccattgccgtaaaaaagccgaaaatgacgagcggttctttctgacgggcagcgatgacgtgggctgaaaacgcccagcaaatcatgccgcaaagccacaccgcgagccaaatccatgaaactttcgcatcttttttcagcaaacctaaaaacgatgtcattctttctctctccattcggatcaagtgtatgagtaacatagtacactagatcatcacgtattacaatatcttcaataaaaaaaagacaaatccgctcttacgcggatttgccttttcaattacttctttttgttttttaaggagagcagcgcatcacgatagctgctatcctgcattttgccgccgctatcaggatcgtttggttcctgatccgtctcagaagtcttaaacttctgaagcgcctgacggtacacatcatcgcccattgtattctttttctcacggggagattcagattttacaacgacgggagcatgctcggctgagcgctcctcggccggatcatgcttttccggctgttcggctgtagtgccgatcgcttctctcttttcttctttgacatcctgtcctgcagaagtgctgcggacattgaaggtgataagaagtgcaatcacaatgacagcagcaataaccgctataataatggccatataaccctctccttactgtcgtccggcagttagattaccagtgacctggctgacacgtctgccaagcgcacggcctaattgaaggccttcttccgtcatcagcacatcgctgtcaaccgggcatgtgacgcccgcgccgtagtaagagccgtacagcgcgttttcaggaacgttgccgggaagaccgacaacaatcatgccttggtgaaacataggagtgatcagattgtgcatggtcatttctaatccgccgtgtgttgtcgccgtcgtacagaatacagcgccgactttatcaatcagctcgccttcagcccacagatagccgagtctgtcgatccacgcttttaagcctgaactgatggtgccaaagtgtcccgggcatccccagataatggcatccatgtctttcagcttgcggatgtctgcttgatcgacatggtcgatcaggacttcagcctcagcgttttctcgtgcgccctcggcaatggcttcagcaagatgttttgtgtgttcgccttcactatcgtacactacgtaaattttcattcaggaaacctcccattcagatgattaagattccttcacttctttaggggccggaagcaatgacagctcctcttttttcttcgcccgctgtttgtctttccgcacgtcacgcaagaacagactcaggactacgccgataaccgcaaagatcgtcgcccacataaacgcgtcattaatccccataacgttggaattgagtgaagctgttttgtagagatatgaataaacggtttgtttcgccgcatcaagcgacatgttcatgttgaccattaaattcgaaaccgcgctttggaacgactgcatgaagcttggatcagccgtgcttgttttatccgcaatctgcgaataatgcattgtcgtacggttcgtataaatcgttgtgatcaaacttgttccgattgatccgctgatctggcggagcgtgttgctcatcgccgtgccgtggctgttcaaccgtgccggaagctggttcattccggctgtcataacaggcatcattaacagtgacataccgaatgcgcggatggcatagacaagcatgatgtgcgtgtaaggtgtgtcaattgtcaattttgtgtactggaatgtcgttgcgaccgtgatgaccagcccgataatcgcaagcggtctcggaccaattttgtcaaacagaataccggaaatcggcgacatgatcagcatgacaatcgcgcccggcaatagcaagagacccgattgcagcgccgtaaagccgactaagttctgcaggtaaatcggaagcaggaacattcctgtgtaaagcgcaacggtaataatgatattaatgacactggaaagtgagaaaatatcatatttaaatacccggaagtcaagcatcggtttttcagagcgcaattgctgaatgacaaacgcggcaatcgcgatgacaccgacaatgacggtagacagcacgatcggatctccccagccgtcgctgcccgcttcactgactccgtaaagcaatgaggcgaatccgacaatagatagaatcgcacccaagctgtcgagtttgattttttgcggttccaccaagttcttaaagaggaaaaacgctatgataataacgattgccccgatcggaacaaggccgtagaacataatgcgccatgtgtaatgctcgatgatccagccggatagagtcggtccgaccgccggagcaaacatcatcgcaagaccgaaaatccccattcctttccccctgctttcaggcgggaagataagcagaatggttgtcatgaccagcggctgcaggataccgccgccgaccgcctgaattaaccggccgatcagcatggttgagaagttaggcgcgattccgcagactaacgttcccgctgtaaaacagaacatggctacgagaaagaggcttctctgtccgaaccgggtgattaagaacgcagataacggaatcaaaacaccgttgaccagcatgtatccggtcgtaagccactgaatcgtcgtcgcactcacaccgaactcggtcattaagtgcggcatcgccacgttaagaagcgtttggttcaagatcgccaggaataacccggccataagcacaataagcaatgttttaggactttttacttgattatctgatttagccacctaagacaacctcccttcatggtttgatgactgatctgtattattcagagatttttacagatgcgttcataccaggaagcaccttgtcagatgggttgctgagtgaaattttaacaggaactttttgcgttactttagtgtagttgccgcttgagtttgaagaaggcagcatatcaaatgttgaatttgtcgcataaccgatttcttctactgttccgtcaaatgttgtattaggatcgccgtcaacaattacgtctactttgtttcctacttcaatgtctctaatgtctgtttctttaatgtttgcagtgatgtaaaggtgtttcatgtcaatttcctgggcaattgtcgtaccggcttgcaccatttggccgtttttcacttcgtttttcacgattgttccatccatgatggcttttacgtcagcattttgctgtcctttaatttttgcaaccacgtcgtttttgcttacttctttcccctcatcaaggttccagtcagttactttacccgcagcaggagctgtgatagcagccatgtcgccggcaactttcgcttcatcggtttttacatagtgtgtgctttgataatagtagtaagcacctccgcctataattgcaagaacaacaatcaaaccgataatgttggtcagaattaaacgtcctctgttcattttgttttctcctttcgtttcttcctctatcattttgtggaatgatgataaaaatatgtggggatttttttattttccgtttttcactgcacagccgtttgcaagcttcgttaaactttccgcaagcttgcgcaggtactgcagttcagcggtattgagctgccggtataagaccgccgctttttcggcatattgaacagcagctttctttagaagttcttccccctcttcggttaactgaatcataacaacacgccggtcgtcgtgatagtcgctccgaaccattaggcggcgcttatacagaatatcggtcattctcgtgacagacgccggtttcagatcaagcgacaaagccagccttgaaagctgcgtgcttttgctcttatgtattttgaacatcagcagatactgcagcactgtaatatcaaaaggttcaagcactgtctccagaatcattttctgctttttgtaaatcgatctggaagtatcaaacagttgttcaaaactgagcaaagcgagctctgattcaatcaccgtattttcacctcattcccttaataatagttcacaagataaaatattaataaatgaaagaaggtttgtaaagagaaaagtttcattttttaaggattttttttatgccgttttttctctttatttttaatttaaaaaagccgggtgaagaaccgcggccgcacgattcttcactcggctttatatttaatacgatgctttgcttataccggcttcctcatttttaaaaaagcttttcagcgcttgaaatacgtccgatttctgtttcaggatgtagtatttaaatttatcatctttgacatttttataggcggacatgagggtggaatgcctgttatattgattgacctcaccgtaacagaacagattcgattttttcatgatgtcattgacgagctttacgcaccgggcgttatccgaagtcaggttatctccgtctgaaaaatgaaacggatagatgttgtagcgggcggggtcatatttttcatcaattaattcaagagacttccggtaaacggaggaacagatggtgcctccgctctcgcctttcgagaaaaaatcttcttccgacacaaccttcgcttccgtatggtgggcgataaattcgatatcaaccgtttcatactttgtccgtaaaaatcgtgtcatccaaaaaaagaaactcctcgccatatacttttcccatacgcccatcgaaccgcttgtatccatcatggctaaaacgacagctttcgattccggcttcgtcacatcattccatgttttgtatttcagatcttccggataaatagggtaaaacgacggcttgcctgtcatggcgtttcgtttataggccgacagcatcgtccttttcttatcgatattccctgtcagcccggttttccggatatcattgaactcgatatcggtatggacgatattgtccctttccttttgctgcagattcggcagttctaattcctgaaacagcgcttcttccagatccatcaatgaaacttccgcttcataataatcctcgcctgcctgatcgcctgctccctggccttttccggcgccctgctttttatctgcgccgtctcttgcgacgacatcgccgacttcgctgtcgccgtcgccttggccgacatgtttatttttatcatagttataacggattttatattcatcaagcgaacgaatcgggattttcacaacatcttttccgttggacataataatgctttcctcagtgacaaggtccggaaggttgttttttatcgcttcctgcactttcttttggtggcgctgctggtcgtcaaagcctttgcgatggagggaccagtcttcctctgaaatcaaaaaatttccgctgtcattacgggacatgaattcccctccttaaccgttatggtcgttttacatgtgtattccggcttggtcctgtttatgaaacaagtccggcgaaaagatttatttttatcttatgccggccggactctccaattgacaaacaattgcgaaaaacagacaaaagaacccgtccttttacagacgggcctctcaatgaaatcaaatatcagcggtttaacaagcttccgacatacttcagcagttcattagcgctagtcgaattatagccgtgttcatctattaaccttgccactacctcattgacctttttaagctgctgttcatccggcgttttggtggaggtcgtaattttcactacatcttttaagtctgcgaacagctttttctgaatcgcttcgcggagtctttcgtgcgaattatagtcaaagcgttttccttttcttgcataggcggatatgcggattaagatttcttcgcggaacgcttttttggcgttttctgaaatgccgatctgctcttcaatggatctcatcagtttttcgtcaggattcatttcttcacccgtcagcggatcgcgaagcttatttttattgcagtacgcttccacattatctaaataattgtccatgagagttttcgcggattcttcatatgaataaacgaacgccttctgcacttcctttttggcgatgtcatcgtactctttcctggcggcggaaataaaattcatataccgctctttgtcctcggcggagatggacggatgctggtcgagtccttcttttaaggaacgcagcacgtcaagcgaattgatggattccatattttttctgataatcgttgaggaaatgcggttgatgacatagcgcgggtcgataccgctcattccttcatcatggaattccttcttcatatcctccagatcaacggaattgtaaccttcaacgctttctccgtcatagagcctcatttttttgacgagatcaatatcagagcggttcggttccttcagccgggtcaaaatagaaaacatcgcggccacttttaatgtatggggggcgatgtgtacgtcagaaacatcactttcagaaatcattttttcataaatccgttcttcctctgacacctttaaattataaggaacaggcatcacgatgatcctggagtgaagggcttcgtttttcttattggcaataaacgagcggtactccgtttcgttcgtatgcgcaacaaccaattcgtcggctgagatgagcgcaaaccgtccggctttgaaattcccttcctgcgtgagtgacagaaggtgccacagaaatttttcatcgcatttcagcatttcctgaaattccatcattccgcggttcgctttatttaattcaccgtcaaaccgataagcgcgcggatctgattccgaaccgtattcggcaatcgtagaaaaatcaatgctccccgtcaaatcggcgatatcctgtgatttcgggtcagacgggctgaaggttccgattccggtacgtttatcctccgagaagaatatacgttcaactttaacatcctcaattctgccgccgtattcttcttcaagccgcatgacattaagcggagaaaggctgccctcaattctgatgccgtattctctgtagaagtcgtcgcgcagatgatggggaatgagatggagaggatcttcatgcatcgggcagcctttaatggcgtaaacagcgccgttatctgtcaatgagtaggcttcaagcccttttttcagcatggtgacaagagttgactttccgccgctgacaggtcccatcaatagtaaaatccgttttcttacatcgagccgcttggcagccgggtgaaagtattcctccacgagccgttccagagattcctcaaggccgaacagctccctcgagaaaaagctgtatgtctttttcccgtcatcctcctcgattccgctgtcttttatcatattaaaaacgcgagaatgagcagactgcgcgaccaatggattttcttttatgatctccaaataatcagcgaacgtcccttcccatttgagacgctgctcttcctctctgtacttttcaattttctttaatatatccataagaacctcctctatcatggttaatgcactagaaataaggtactttgttacaatctatgcggtgacgtgataatacatgcttttcgtttcttaaaaataaagacgttataaggccgtcattgacaagggtccggtgcaccgttcataatgaaagaaatacagtttcatccagactcggacatcaaatggaaaagcaaagaggaggagacatgatgaaaacgatcattttacttggggtcattctcacttttttagtatccatttttactgcgggttacgacagcaaacctgaaaacaaataacggcaaaagggtgctctttatgaagagcaccctttcctgtacaacataacaatgtttcatatttgaatatgttcttggacagttgatttttcatgagacttacagcttgtttgatactcgatttttccgattttgcagcccgggccgatttccacacgcttccctctgacgatgtccgcttccgtggattcgaggtaaattgcgtctccttcgatcaattcagcagaaagcatgccggctttccgtttaagaaaaccgggtttccgtctgacggtaatcgatgtgccgccgatttctttcacgcggcttcggtcataacgcaaatggatgtttacgtcccctgcgtttaacaatcccgccacattgatacatcctgttacatgaagcagctccgtctcgcaatcgccgccgacggtgagactgccttttatatgacactgttctcccgcggccccgccgccaatttcagcaagtcccttcagcctcatcctggcaaaacgcatggagccgccgactttcaatgtgccgatcacatttgctgaatgtgctgataaatctcctgcaacttcatgctctccgaaaattttcagcctgctgatctcggcatctccgagaaaaagtcccgtgccgaatatccggcagcgttcgctttgaagtccttcgccgacagttccttcccctttaatgcttacattttggtaggaaccgccggaagcgtgtccggctccgtacatttttaaatgactcaatttttttgtcgtttccattgcagctcctcctatcgtttcacgactttgttaaccaaagcggtaggatcacatgtaaaatcgccgctgtattccaccgtcccaatggtgcagcccgcgccgatccgcacatgatttccgcggactgtcttcgcgttcgtgtccgccaattcaatgatgtcaccctcaatcagctctgctgtcagcaccggggccggcatcagcttaaaacgcgtaagcacgctctttctgctcatcactttcaaatggcggcagccgatttctttcacatgactttctcccgcagccagcttcatactgacttcatcggcattcagcaggccgccgatcttgcatttgccttccgaacggaatgtctctgtctcgcaatcaccttcaatcccggctttcccggatatgaaaatatcatcagctttcacaccgccgccgaaagatgaaaatcccgcgacgttcagccgctccgttttgacatcacctttaatgacacccgttccgttgatacggatggattcagcttcggcactgccggaaattttccccgaaccgctgattgtcagtgtttgcgtcttgacatgtccgtctgtttttccgctgccgttaaacaaaaggctcgtgcactccacatcacctgacaccgtgccgctcccgttgatctccactgtatgaaaacggcctccttttgaacttcccgaaccgttaatgattaatttatctgttacttccattgatggtcctcctgcatccatttcgtttttaattcttccgatgccgcagcaagcgccacccgttcaaccactttgacagtcggttcaaataaaatatgttccgcgtctgcgatgaagcacgtcgttacgccgagctttcggagcatgacaagctccgtattcgctttcagctcggaagcctcatacgtcttcagcacccccgccgccaattttccttcctcaaggctgatattgcccgattgcaaaagcccttcaagcacatataaagacagcagcgcgcgggacgtgaatgtcacgccgtcttcgccataaacttgcagcgcggcttttgaaatcagtcccttttgaagcagttccgcagacgttatattgacatcagtcatttgcggagacagcatttctctcatttcatccagagacagattttctttcatttcctgtatttttgagatgcgttttaatatttccgctctcggaaaaaatgtttcctggcctgtaaacgtcgattttcggataaaccattcttcaggaattaaatttttccgtttccaccggtacagctgcccgtatgaaattgatgtttcttccagcaattcttttttagaaatcagttgttcctccatgaatccagctccttcgatgaacgtattgtaacataacactgttacgttgttaagcccggaaatataaaaatgccgtaaaccgctgctgcccgtcttttttattcaataaaaaaacgcccggatgcgggcgttttttctcacgtcaaatctctgtaattttgctggcgcagcgcttcatatacaagaatcgcggccgtgttggacagatttaatgatctcacatgctcggtcatcggcagacgcaggcagcggtccatattgttttcgatcaattctttcggaagtccgctcgtttctctgccgaatacgaagaaaaagtcttcctccgtatttgagtaatcaaatgatgtgtgcggcttttgaccgaattttgtaatgaagaaaaactttccgttttcatatgcttcaaataactcttccaatgaatcatgatatacgacgttgacgaactcccaataatcgagtccggcgcgcttcagcattttatcatcggttgagaatccgagcgggcggatcaaatgaagcgttgtgtctgttgccgcacaagtacgtgcgatatttcccgtattggccgggatttcgggttgatataaaacgacatgtaatgccacgatgttcacctctgttttttattccgcccaccattatatcattaattactcttttgtcgtatcatccgtaatatgaaaaaacgcatatctgatggaaggagtatacgccgttgaatcctcatatgaccaatatctcatcctgctgtcatacgtttgggcattgacgagcggcatattgcttttatcttttgcgaccacgatcgccgtatgattaaaacggccgtctccttcaaaatcatagcaaatgatatctccgggcatcagttcttcagctcttgatacttgcactgcgcgaagccctgccttggattgggccagatacatcttcatcgaatgcgcgaccgtccagctgtagctccacgagcttgccttcatccaccagcctgagcctctgttcggatgcccccgcatcggtgcttttccggcatgtaaacattgggaaataaaattggtgcaattatcgctgaaatttttataagcgggatttcgtttattccaaaacttctccgcgtactgcacggcagccagacggtcgtattgaaacgcccgcccgaaatcttcccgttcactccgctcatattcaattacgctgtttccgtcagaaaatccagccggttttttctttacttcccggtctttaatcaaaagctcatcatagagaaatgcagtccgttcctcaatctgctcttctaagtaaaggtgtccgtcatgctccttgcacaaatattcgaaatgaatcgtgtacatgacacataacgtgccgtcgtcctcaagactgcttttgacaatgacggcttttgccttcgctttcacgatatcaactttccgtttttcaaacagctctttttttctcgtcaggacctcaagatcgccggcctgcccattctgcctcatctcagttccgttgattaaataatgaagccgggcctccgctaaatcttcaataatatgcttcaagcgctccacccaccatacgattttataaagaaaaaacacttgaactccggccaagtgctttttctctatacatatgtcaggaccggccggttttagtcttctcagaaaccgataacagctccagtcccttttcaatttcccgtatggcgtcttcatcctgctccttttgaagcgctttttctaattcctccgcataatcaggatcaccgattttcccgatggcccaggcggccgtacccctgatgacggggcgcggatcttggtgcatcaaggccgttaattccggaagagacgaggcatctttaaaatgagccaaagctaaaatcgcattccgctgtatcggcttcttgccgcgccatgatcccgatacatgtccgaatttttctttgaattcgcggttgcttatggtcaaaagcggctttaacagcggctttgcgatttccggatcaggctccatctgcggatgaagatgaaaatctttccccttattaatcggacagaccgtctggcacgtgtcacagccatacagacggtttccgattttcgtgcggaactcatccggcaaaaatccctttgtctgggtcaggaacgaaatacagcgctgggcgttaagctgtccgggattgacgagggcgccggtcggacacgcgtctagacattttgtgcacgtaccgcacatatcttcaatcggcacatccggttcaaagggcagattggtgatcatttcagccagatagacgtaagaaccgtattcaggcgtggtgatcatgcagtttttggcgctgaagccgattcccgcccgttcagccacggccctgtcggacaattctcctgtatccaccattgactttgtgcggatatcctcatgtttgctttggagaaaattctccagcagatcaagcttttcccgcagcacatcatgataatccttcccccaggaagctctgcaaaaaatgccgcgccgcccgtccctcgtgctcctcggcgcatctttcattttggaaggataagcaagggcgatggcgacgattgatttggctttcgggagaagcaaagacggagtaacccgtttttcaatatccggctcttcaaaaccggataaatagccgagtgattcctgaagaatcagccggtcccgcagactgtcgaacgtatcagccgttgtaaacccgattttgtcaactccgatgcttttggcgtattcgattaattcctctttcagtttatgaatattcattttttgcacagcctcctttctttgtgatcaggctcccgcacgggtataatagagttttatcatcccgaaatggagtgaacacacttgaacatcagtttagatccacttattgctgaacgggtgccggggatcaaagcggcagccgtcttatatgaacagatcgaagtcgggcctgctccgcaaatgctgaaaggccgcctccgtttatttcaagaatctctttactttgattatgctgacggcggtatagatgagcagccttttgttaaagagtgggcgtgtataatggaacagctcagtcccgccttttcaggacaaaaaacgccgatggagcttatgctcggcgatatttcccgggaacgattcattgaaagtgtgaattcagcccatgataccatactttttttctccttgaaatattcattgcctatcatggcgtatgacgccgcagaaatagatgaaccgatttcgattacaatcggagaaaaagaacacgtacttgctttctccgactctggcggcattttcggcggccttaccggacatatcaacacccgccctgtaacaatcggcacaaagaaaatgctgcagctgatctttttcccgccttcatttcatgccgacgcggcggatgagctgctatcatctttaaccaaaatgtttgaacaaattcacggaggcacgcataccgtctcttggctttcataaaaagacacgccttcgtgtcttttttcacataaaaaaacgcaatacttcgtttatcagagaaacgaaacactgcgttaataacgtatgtatggagcgggtgatgagaatcgaactcacgacatcagcttggaaggctgaggttttaccactaaactacacccgcatcaaagttttttgtcagtaccgatttgatgtttctaatattacatgtatatttttttttcgtcaagggaatgttaaaaaatttgtcgaaaaaaattcttttttcgtccacatgttaagttaggtttacattttgttaagaatctcatacaatataaaaaagaagaaaacttgaggtacgccctgatgatgaaaaataaagtaaaagagctgagagccagattcggctattctcaggaaacgctcggaaaagaagccggagccaccagacagacgattgcagcgattgaaaaaggagattatgtgccttcactcttattggcgcttaacatctgccgggctttctccctgccgatggaggaagttttctggctggaggaggagaaaaaatgagtttgaaaagaaaagcgtgttttcaccttgcactctacggattggcctgctggacgcttatttcctttatggaagcggcgccgcggatcgctcagtttttccaaacggaggggagcggtgcatttgagctgaatatcactccgtttctgctgtttaccgtttgtgccgcattgtatatctatgccgaaaagaaaaaacgaaacggcaaaaagcataggctagtgcccgatgaatttgaggaacaggatgaaagagaacgaatgatgacggctaaagcttgccgttcctcgtatatcgccgtttacttctcattgccggccgcagccgttctgcttttgttttatccgctgattcagccgcatctacctttttttccgattcttttgattttcattctgatgatgattcagcatttggcttatgttttcacttttcataagcacggcaaaaactccggttcatgacagatccggagttttttatgttaccagctcgcttttttcaccccgggaacccggcctttatgggccagctccctgaatgcgattctggacagtttaaattttctcatatatccgcggggccgccccgtcaccgtacagcggttatgaagcctggccggagcagaatcacgcggcagtttgctcagcgcttcccagtcgccttttgcctttaattctcttcggatgtccgcatattgttcaacaagcttctgccgcttgagctctttgattacttttgatttttttgccatttcagcactcctaacaaatcgtaataattacgttttgtatcatatcatccagatgagcatcgtgcaagctaagcgcttaaaaaggcgggtgaatacccgccttcactgccggcatttccccggaaatgaatccgcagaaagcgcccgccgtcaatgatccgccttgcgacgtcatcagactgtcgctttatttcctcttgcaaaatggtcgtttcccattgcttcacccactctgcgctcaagcttgttagtccgttcattctgaaacggcagaagcggaaacacgagttcagccagataataagcttcttccagatgcggatagcctgaaaagataaacgactcaatgccgagtgcctgatactctaaaattcgatcagcgacagtctgcggatcaccgacaagcgccgtgcccgctccgcctctgaccagtccgatgccggcccagagattcgggctgatctcaagcttcgagcggtcaccgttatgaagatcggccatccgtttttgtcccgatgaatcagcgcgccggagcgcagcctgcgctttcgcaattgtctcttcgtctaagtggctgattaatcgttcagccgcttcccatgcctcttcctcagtctcccggacaatcacgtgaagtctgatgccaaaacgcatcgtccttccttccttggcagcctgttttttaacggtttcaatcttttcttttacctgctccggcggctctccccatgttaaatagacatctgtatgtttcgcagcagcctcaattcccgcctgtgatgaaccgccgaaatataatggcggatgcggagactgttttggcgggaacaggaggttgctgttttccaccttgatatggtccccttcatatgtcaccgtttcgccccgcatgagtccgcgccagacggttaaaaattcttcagtcgccttataacgttcatcgtggctgataaacatgccgtctcccgccagttcataaggatctccgcccgctacgacatttacgagcaaacggccgtctgacagccggtccattgtcgacgccattctcgcggcgacagacggctgcatcagtcccggccggaccgccactaaaaatttcaagtcactcgtttcccccgctaaagcggcagccgtcagccacgggtcttcgcatgatctccccgtcggcagcagaacccccgtatacccgagtctgtccgccgcctgtgccacttgcttaaaataaagatgatccgccgttctccctcccgtttgcgtccctaaataccggccgtcaccatgcgtcggaataaaccaaagaatctccatatgaatctctccttttttaataggttacccttcataactgttccgccattttaatagtttccgttcgagcattctgaccaatgcatctgtcagcttgccgacagccgcaaaaatgataatgccgacaaacaccttatttgtctgtgaaaattgtctggcatccataatcatataaccgacgccctcgctcgatcccatcagttccgccaccacgagaccgagccacgcaatgcctagggagagcctgatgccgagcaggatattcgggagagatgccggaagaattaatttcgtcatctgctgataccaattaaattccagcacccgcgcgacgtcaaacagcttcgcgtccacactgcggattccgagaaacgtattaatgtatacgggaaaaaaagcccccaatgcgatcagcagaattttagatgtctcatcaaatccgaaccacaaaatgaacagaggagtcacggccaagtgcggaaccgtcctgagcatttgcagagacggatcaaggtatgcttccgtccgctttgaaaaaccgaccagcagcccggaaacaagtccgaggcccgcgccaagcagaaatccggcagccgcccggtataaactgatctctaaatgaccccaaagctcacctgaaagaagaagttcctgaaacgtctgcaagatgacgacaggcgacgagagcaccgcggccgagacgatgcccagacttgcgataaactgccatactgcgatgaccgcagccgggagtacaatccctttcatccattggtatgaatacttccgggatcttgccagagctttcttttctgattggcttattgcgccggcagccgttgatgcttctgctttcattacttgccatcccccgtttcaagcgcttttttaataaatgaattgtcgacaacgtcttttacatgaattttcttatgaatcgcttttgttcgatattgaaaatcagcggtttcctgctgggctttgacaatatcatcatcgatcggttcattgagaggctcagtattgttaagcacgtttctgacgactttcggatcaagatgtttgattttcgcatataaggagacggcttcatctttgtgttccttttgccatgtaactgctttattgaacactttcagaaaacggacaacctcatccgggtgttctttggaaaatcccgttctgactaatgtgaaaccgggagaatataaatctgtgctttctccgttcgccaatatttccgccccgtgctgcagcgtttcaatcgacaaatacggctcccaaatggaccatgcgtcaactgatttgttttcaaaagcggaaaccgcctcatcgggctgaagctggatgatggtgacgtcatcggcggaaagccccgctttatctaaagctttatagagaaaatcaaagccgctgctgcctttggctacggcgatttttttacctttcaattctttcaggctctgaatcccgctgcccttgtttacgagaatgccgtttgcctttaacccgtcctgagacagcccgatctctttaaaatcaattcccgccgcctgaccggaaatgaccggtgaattgccgacctgggaaaaatcaagcttatcggcggcaagaccttcaaattgcggaggaccgctttggaattcgacccattttacttttattccgtcttttttgaaggcctcttcaaaccagcctttttccttggcaatgagaagcgggcttaaactctgctggatgccgatccggatttctttcaccgttttcccgccccctcctgtcccgtctgcactgcatccggctgacatcatgactgctgcggctaaaagaatgatgatttttttcacttcgcttcgtcccttctatattccggacccatccgcaaaccggaggtcttccgttttctcaaattcagaaagcaccttctgccggacggcctgaaaatccgctgacgtccgattgcgcggatgcggaagctgaatcggcatcaggctgtgcagccggccgggctttgccctgaggatcgccagcttatcgcctaaatagacggattcatcaatatcatgcgtgacaagaatcatcgtcgtttttttctcgcgccatatatcaagcagcacatcctgcaaatgttttctcgtaaaagcgtcaagcgccccgaacggttcatctaaaagcagcacctccggctcacgcaaaagggctctggcgatggcaacccgctgcgacatgccgccggataattcgcgcggataagcgttctccgctccctgcagcctgacaacctcaatcagatcatccacttttttccgaacggccgggtcgttcatattgagatcggcagcgatgttttgttttaccgtcagccagggaaacagccggtgctcctgaaagataaatccctgccggatgcccggtcccgacacattgcggccgtttattgcgacagagcctttataatcggtatcaagaccggcaatcaattttaaaagcgtgcttttgccgcatccgctcggtccgatgacagtcaaaaattctcccgatgcaattgacagctcaatatcattcagcaccggcgttttccggccttcatgctcaaaagctttttcttgtatgctgatggttacagccatctgtcttcccctctctttctgccgcatgcgatcgaaaaacaaaaaggcccccatctccgattgcttgcagagatgggagccttcggcggtccgatcggcaacccgtttgtttttaaatttgaatatcatgttaattcaaattattccgacttgtcaactgttttttgtatgaattaaaaatgcgccttccggcataaacctgccaaagagcgcatcggctgtatcacgtatttacttccttttctttccgggcgattttcaataatgtctgcgcgttgttgccgaaaatgttttctatatcttcttcccgcatattgatttcccggcaggtcctcacctgctcctgaagatatctgtatacatatcctctcggaaatccgttcgaatccgtcccgaagatgatccgttcagcaccgattaattcagatgtctttcgaaacagaatttccaaatcaagccggtacggcatccacctcatccactgatttgagccggacgtgtcaatatacacattcgggcagctccagcacagctgcagcagttcctgataatatccggcgccgaaatgcggaatgatgaacggtatatcagcatactctctcgcgacgcgatagatggagagcgggttgatgttgcgatggctgacaatgccccccgctctccctaaaagtccgaagtgaattaatacaggcagtcttttgtcagccagatacgtccacagctttttcagcgacggatcatgaaactcgatgtctgtcagcggcccgaacagtttatatcctttcagaccgagctcttcaaccgctcttttcagctcctcatacgcatccttttgttccaaaggatgatatgcaaatccggtaaacctcgcgggattggcttgaataaacgccgccatccggtcattgctctctgctgttaaaaaattcagcacgtcaatgccgtacttatctaattctttctcccatcttgtcatcaaagcgatttcgccgtcatcgccatcaacatcatgcggatcaggaaaatcccaagtgagattcattctttccgaccgctcccggttataatcggaaaatgtcttatcgtttttgccgaaattaaggctgtacggcagatgaccgtgaatatcgacaggtttaaaatgctgccggaaaagcatacaatcgccgcctcccttaccgcctgacaataaaaaaaggcccttatccagtgaagaataagagcctcttgtgtccaagtcagcggtttctattttttctcatattaaacccattattcccgtcagtcaagtgtgttattaaacccataccttcttttcgataataaaaataattattttataatcattataaaataatattgactttttactgataggtgatattatgttcttataaatttaaagaggtgatcacatgagttcaaataaactgacaaccagctggggcgctcctgtcggagataaccaaaactcaatgacggccggcgatcgcggtcctgctttaatacaagacgtccatctgcttgagaaattggcgcactttaacagagaacgcgttccggagcgtgtcgttcacgcaaaaggcgcgggcgcacacggttattttgaagtcacaaatgacgttacaaaatatacgaaagccgcatttctgtcagaagtcggtaaacgcacgccgcttttcatccgtttctcaaccgttgcgggcgaactgggctctagtgacacagtgcgcgacccgcgcggatttgccgttaaattttatacagaagaaggaaactacgatatcgtcggaaacaatacacccgtgttcttcatccgcgatgccatcaagttccctgactttatccatacacaaaaaagagatccgagaacacatctgaaaaatccgacggccgtttgggatttctggtctttgtcacccgaatccctgcaccaggtaaccattctgatgtcagaccggggcattccggcgactcttcgccatatgcacggattcggaagccatacatttaaatggacaaatgataaaggcgaaggcgtctggattaaatatcactttaaaacagagcaaggcgtgaaaaaccttgatgttaatacagccgcaaaaatcgcgggcgaaaatcccgattaccatacggaagatttgttcaatgcgattgaaaacggcgatttccccgcatggaaattatatgttcaaatcatgccgttagaagatgcaaacacatatcgctttgatccgtttgacgtcacaaaagtatggtctcaaaaagactatccgctgatcgaagtcggccgcatggttctgaaccgcaatccggaaaattactttgcggaagtagaacaggcgacgttctctcccggcacattagtgcccggcgtcgacgtctcacctgacaaaatgcttcaaggccggttgttcgcataccatgacgcgcatcgctaccgtgtcggcgcgaaccatcaggcgctgccgatcaaccgttcccgcaatgaagtgaaaaactatcagcgtgacggacaaatgcgttttgatgataacggcggccgctccgtctattacgagcctaacagcttcggcggcccgaaagagtcacctgaagataaacaggcggcataccctgtatcaggtttcgctgacagtgtaagctataatcatcatgatcattacacacaagccggcgacctgtaccgcctgatgagcgaggaagagcgcgcgcgccttgtcgccaatatcgtcagtgcgatgaaacctgtggaaaaagaagaaattaagctgcgccagatcggccacttctacaaggctgatcctgaatacggcagacgcgttgccgaaggactcggactgccgtcaccaaaataacatcaaaaaacctgccggtctgcccggcaggttttttatgttcattatcaataaaaccgtttttttctcaattacacgaagtggcatgccgcaaaatgatgaaaccctttttctgacagcgccggacttttctcagcacatatcttcttggctgccggacatctcgttcggaatttacagcctgaaggcggatcagaggggcttggtatatcaccctttaaaattatccgctcccttttcgctccgggatcaggaacaggcacggctgataacagcgctttcgtataagggtgaagcggccgtgaaaagagctcctcctttgacgcatattccacaatcgtccctaaatacataatggcgaccttcgtacataagtgctccaccacgcttaaatcatgagaaatgaacaagtatgacagcccgtgctgtttttgaaggctgctgaacaaattgatcatctgcgcctggatggagacatctaacgccgccacgggttcatccataatgataaattgcggtttgagcgccatcgctcttgcaatcacgatccgctgccgctgccctcctgaaaattcatgcggataacgatcgatgaagtttgcggaaagtccgcaggcttcaagaacctccgccgctttatcacgcgcattccgcttcaccgccaattgatgctcgatcatcgcttcaccgatggcttctccgatccggcgccggggatttaaagaactgaacggatcttgaaagatgagctgcgcttccgatctgaaagttttgagctcgcgccggctcatccgaaacacatcacgcccctgaaaaaacacctctccccctgttttctcatgaagcctcaaaatggtcttgccgattgatgactttccgctgcccgattctcccgctaagccgaacacttctccctttcctatcgtaaaactgacaccgtcaaccgcttttacgggttttttatgagtctttctcatccccccatgctcctcgtaatattttttcagccccttgacctccagcaacacatcactcatctgctttctcctctctgtaaagccagcacgccgcctgatgccccttcccgaattcagtaaaatgcgggctcgatctccggcatatttccgtgctgtgttcacatcgctccgcaaaataacaagacgatcccgacaggtccgcaagctcggggacctgccccggaatggtgtaaagcgtctcccttttttgaccgataaccggcttggccgcgagcagccctttcgtatacggatgcttcggatcagaaaacagctctgcaaccggtccttcctccacaatttttcccgcatacatgacaatcacataatcagccatttcagcaaccacgccaaggtcatgagtaatgaataaaatagacgtgcgaaattgctttttcatatcccgcaataaatccaatatttgcgcctgaatggttacgtcaagcgctgtcgtcggctcgtcggcaatgatcagtttcggatcgcagcttagcgcgacagccgtcatgatgcgttgcagcatgccgccgctcagctcatgaggatatcggtgcataacctgctcggcattcgggatctccactaacgtgatcagttcaacggctctccgccatgcctctttcttactcagcaacaaatgttcgcgaatcggttcggtcagctgctcaccgattgtaaacaccggattcaaagatgtcatcggttcctgaaaaatcatcccgatttcgcttccgcggattttctgcatgtcttttggtttcagttccaacaggttctgtccggaaaaatgcaccgctccccgttcgattctccccgtctcgggaataagctgcataatggacaatgacgccatacttttcccgcagccggactctcctacaatacaaaccgtttcctcctcatgtatcgtaaagctgactccgtccacggcctttaccgcaccctcctctgtataaaaagccgtttccaaatgccttacttctaaaagcggttttttcatttcattttcacctgccgttttaccttaggatcaaaagcgtctcttaaaccgtctccaagcaaatgaatcgccacaacggtcagaaaaatggccgttcccggcggaatccacagccacgggcggagtgtaaaatccataaaatgattcgccgcttccatcatgtttccccaagaaggtgtcggcggagcaacgccaagcccgagaaaactcagcgcagattcactcagcatcgctcccgccacatgcaaagtcgccgctaccagtaataacggcaatgtgttgggaagcaaatgatagaggattttccgtttatcactaagccccaaaacttccgcggccatcataaacagctgctccttcagcgacaaaatctgtccgcgtacaagccgcgccaaaccgggccatccgatcaggcttaacatcatcataatcaggtacattctgtattcagaaggcactttccactccgacatcaccgcagccaaaatcaaaagcagcggcaggcccgggatggacatgagcatatcagcaatgcgcataatgatcatatcagcggctccccgataaaacccggccgcagccccgagtaaagagccgatgacaagcgacagcaccattgaagcaagccccacggtcagagaaatctgccccgccagcatcagcctcgtcagcacatctctcccgtactggtcggtgcccagccagtgatggattcccggatgctgattggcatttgaaatatccgtccgatctgttatgtacggagaaaaagacggcccgataaagcacaataaaaacataaaatataagaaaagaagactgatgaccgtcagcttatgctgcagcaggcggcggtacgtctgcttccaaagagaaggcggcacctctttttgttttttcattccgaacaccccctatttcagtctgacccgcggatcaaccgcggcataagcgatatccgccaagaagttccctacaatcgttaaacaagacaaaaacaaggtaaacgccatcaaaaccggataatcacgataatgcacagattcaagctgaatacgtccgacacccggccacccgaaaatctgttcaataatgatggctccggaaaacagtcccggcagttcaaaagcaagcagggtgatggccggaataagcgcgtttttcaacgcatgtttccagatgacggtgcgctctttcaatcccttcgctctcgccgttctgatataatcctgtctgatcacgtccagcatgccggagcggaaataccttgtcagcgagccgatgccgagcatagataaaatcacgaccggaagaatcatatgtctggcggcttcaagcacgtacgaaaaacctgtactcgtgctgccggtatcaatcatcccgccgacgggcaatattttcaaatccaccccaaaccacttaataaacagaaggctgataaaaaaagacggaaacgccatggaagcaaaaacaagaaacgtcacgatcccgtcaaaccatgagtatttcctgacagcggatatgacacccgttatcatcgcggctgaccatgtaacaagcaacgccaaaaacgcgacaaaaaacgaattccagacatatttccgaagcagtgacaggacgttctcctgatatttcaaagaaaacccaaaatctccgctgagcacatttccgagccatgtcacataacgctgccaaatcggctgatccagcccgtaaagcgcttttaactccttcgctctttccggagtcaggtttacattggaatcaatatagtcgcccggcagcatggcgaataagaaaaaaataataaaggacgtaccgaataagatcacaagcatttgaatgaatcgttctgcggcataccgtttcataaaaagcccctcctttccgctgaaagggcaaaatccccaggatgcatcgggtattttgcccaaccgttctattgaattgagacatttgagagacttgaactgattccagaataattgtcagcctcaagcccttttatttttccgctgaccgcccttgcgctctgacggtaatgaatcagaatgtaaggcgggttttccccgagctcccggtacagctggtgataaatctcttttcttttgctgatatcaagcgtgccggctcctttctctatcagccggtccgctttcggattggaataccccgtcacattattgggatggccggaagccagcttttccaccgtgtcattcggatcaaggatctgcgaggtggaaacggcggcaaggtcatattgtttgtcattgattttcgctacttctgtattaaaatccatcacttccggttttaatgagattccgatgtccgcataattttctttcgctatcgggatgaaatcatcatccgctttagatgtgtaatagctgatttcaagctttttgccgtttttttcacgtacaccgtctttgcccgttttccagcctgcttcgtcaagaagctttttggctttttcagggttaaacgcataccgattgacacctttgtcatcataagcccacgaaaccggagacaccggaacattcgcgacctctccgtagcgtttaaagcggacatcgacgattttttgacggtcaagtccgtaaataagcgcctgggacactttcttatcttgaaaaggcggacgcttgtgattgacgtacacaagcccgtaatcattcacgacagatacgcttatattcgcaaaaccgagactttttaaatgctgaaccgtatcatcatcaggtgagaaagaagcgtaatcaaggtcacccgtttcaaacagctgaagggaagttgacggatcgataattttataaatcagcttttccgttttcggttttccggcataatagtgttcattagcctgatagcgtatttcctgtcccggaaggtattctgtaaattgataaggtcccgctccgagcggtttggcataaagctcttttaaatagtccagtttgccgaattgatatttcttcccgtagtaggcttctgacagcacctgcccgcccaaaagaagcagcgacttcgcactgactttctcagtcgtgatttgaatggttctgtcatcaaggacgcgaatgccctctatcgtctttgcctttccttctttgtaagccttaccgcctttaatataagccgtggtgatatcttcatagcccgcgtatgcaggatcatgcagcagtgttaaagtgaatgcggcatcctttgcggtcagcggtgaaccgtcgctgaaaacgagattttttcttaaacggaacgtgtatgtaagctgatctttggaaattttccagctttccgcaagagccggggcaggcttccccgttttatccagtttgactaacggttcaaaaataggatctgtcgcatttccatcccagccgttttcgtaaaagtacggcagaaacacgccgcccggcgcggaaatcccagcaacaaaagtgtcagttctggctttcgatttagcgggaatcgccgccggatgagaagctttaaattcctttgtcttgacatgggtgatacgtgtttcttcctttttatcagccgcagatgacggttcttccccggcactccctaacgcgcaccctgataacatgatggataccgacagcgcgagtaccgttgttttcaacctccattttctctccttcatctttatcgaacccccgcatgcttttcatctatctttatataaatctgctccatctgttcctcatttctcataatctcccgtttgtttttctctacaagcagttcgaaattcaatgtgtgttttctgtactttttccgcttttttctctttttgcgcacatgtgataccttttttaacgccacttttcatccctccgcttttcatttaatgactttcacgcaaaaaaggcccttatctgtttaatagataagagccttcggtgatccgatcagccatcgtttggaaatatgtaatgattatgttaattcatacaatccctacctgtcaactacaatttaaaatatcgtgtccttccgggggttttcctcatacactctctcatttttccgcatatgctagaaaacatagcagattacaagtgaaagtgagtgagaatgtggaaaagacaacattgagcggtcgcatcgtcaaaaaagatgacccggactataatgccgcaagaaccaatttcaatttaagcctgcaaagatatccagacatcattgtgttttgccaaaacaaacatgacgccctcaatgcggtgagatgggcacgtgagaacaatgtgcctttccgtatcagaggcggaagacacagctacgaaaatttttccctgttaaatgacggactagtcattgatctcagtgaaatgaagaaaataagagtaaatgaggataagcggctggtctcgattgaagcgggagccgaattaggggaagtctaccggacactctggcggtacggcttgacccttcctgcgggaaccattgcgaatgtgggaatcacggggctgacgctcgggggaggaatcggatatttaacaaggactgccggacttacttgcgatcgtctcctccagctcgaaatgatcatagcggacgaaaaagcgggtgctgacttgatcacagtcaaccgctcaaagcactctgatctattttgggcatctcagggcggagggggaggcaacttcggcattgtcacatccatgatgtttaaagccgtgccgatctcgtgcgtgtctgttttttctgtcacttggggctgggatgatttcgaggaagtatttaatacgtggcagcgctgggctccatttacagacaaccggcttacctcatcaattcagttttggcctaaggaagtcaaccgcatagaagcactcggtcaatttaccgggacaaaagaggagctgaaagaactgctggctccgttaatgaaagcgggaaaaccgacaagcggcatggtcaagacagtgccatttattaaagcagcagccttttttaacagcccgggaggcaatcagccgcaaaagatgaagcggtcaggatcctttattgaaaaaccattatcaacacgcgcaatatccactttaaagcgctatttagagcacgctccgaacgaaaacgccagtgtctggcagcaatctctcggcggggcggccggacggatcgctccggaccaaacggcattctactatcgcaacgcaatcattgcccaagaatatattacaacttggacatctgctgaagaagaaagacaaaatgtccgctggatcgaaggactgagaacgtccctatcaagagaaacgatgggagattatgtgaattggcctgatagagaaatcagaaactggctgcaaacgtattacggagaaaatgttcaccgcctccgtcaagtcaaaacgaaatatgatccggaaaatatattccgcttcgagcagagcattccgccgcttcgccgttcaccgtttttctaaaaaagatgaagatggatacactccatcttcatcttttcttttattgatataagcggcttcccttctctgcaaactcttttgctttttctttcagcccttcattgacggcctcgtcttcagtaagtccgttttccttcgcataatcacgaatatcctgagaaattctcatgctgcagaacttcgggccgcacatcgaacagaagtgagccgtttttgcgccttcagccggcagcgtttcatcatgatattccattgctctttcaggatcaagcgacaaatgaaattgatcacgccaccggaattcaaaccgcgccttagacagagcatcgtcacggatctgtgcacccggatgccctttagcaaggtctgcggcatgtgccgcgattttgtacgtaatgacgccttctcttacatcatcacgattcggcagccccaaatgctccttcggcgtgacatagcaaagcatcgccgtcccgtaccagccgatcatcgccgcgccgattgctgaagtaatgtggtcatagcccggagcgatatccgtcgttaatgggccgagcgtgtaaaaaggcgcctctttacaaatttccagctgcttgtccatgttttccttaattttatgcatcggcacatgacccggtccttcgatcatcacttgcacatcgtgcttccacgcaatctccgtcaattctccgagagtctccaattccgcaaactgcgcttcatcattggcatccgcaatcgaacccggacgaagcccgtcaccaagtgaaaaagcgatatcatagctcttcatgatttcacaaatttcttcaaaatgcgtgtacagaaagctttcctgatgatgagccaggcaccattgcgccataatcgccccgccgcgggatacgattcccgtcgtgcgtttagccgttaacgggacataacgaagcagtacgccggcatgaatggtgaaataatccacgccctgctccgcctgctcaatcaatgtgtcacgataaatgtcccacgttaaatcctcggcaatgccattaactttttcaagcgcctgataaatcggcaccgtccccacaggcacggggcagttgcggataatccattcacgcgtcgtatgaatgtcttttcccgtggataaatccatcatcgtatcagcgccccagcgaatcgcccacgtcattttttcgacttcttcttcgatagaagatgtaacagccgagttgccgatattggcattaattttcacatgaaaattccggccgataatcatcggctcgctttccgggtggttgacgttagaaggaataatcgcccggccgctggctacctcgtctctgacaaattcgggagacacatgctcgcgaattgcgataaactccatttccggcgtaatgatgccttttctcgcataatgcaattgtgttacatttttccccggcttggcccgaagcggtttccgctgcaggccggggtattcggcagcatgatcttcttttttatagccgttgtcttcaggtctcacggtccggccgttatattcttctacttctccgcgcccggtaatccactttgtgcggagcgcccccagaccttcatgaatatcaatctgtacatccgggtctgtatacggtccgctcgtatcataaacacggaccggcgcattctcctcttccccgaatgcccccgtagtcgcactcaggctgatttcccgcatcggcactcgtatgtcgggcgaagaaccttctgcataaacctttttactgccggaaaaactcgacataatggaaatgttcgcttgctgtactgattgattttgcatacaaatctctcctttatcatttgaataacagaaccaagctcagcaccagcacaaaaaaaccgggttcaaagaagaacccggttttgcagtcagaaagaaactattattgttttcctcaacaataataaaacctttacttccccacgctggtacgaaccagatcaggtccaaagggttaagaagccgccgcttctctctcagcccgctcagacgggcacccccagtaactattgatttcgctctcatcgtaacataagttgtgtacaaaaaaaagcatattatcaaaattcagataacggaatggtcataagctctgtttcccgaacgccttcttcggtattaaaaacccgataaccctttgcggtttcccgggaagagacagcccggaacagctgaccgtctttataatgaagcgcagcgccgtcatcagcggcatagccctccctgagtatcttttcggaaatcagacggtgatacaccggccggcgctccgcttctccgtcatagtgcggacaaaagctgcccggcaaaaatcctaaagctgttaactctcgcaaatcccccgctgaatccgtcaccccttcttcataccagcaaatcgctccggcgctgagacccgctaagatgatgccgttttcccaagcctcacgaagaataaggtcaagcccccactctttccataagacaagcatattgcgcgtatttccgccgccgacatatataatatctttcttcatgagaaaggatctgagatcagaacccggcggtttaaacagcgacaagtgatccggctcacaccgcagcttttgaaaggcctgataaaacctgccggtatatttctccgaatctccgcttgccgtcggcaaaaaacaaactttcggctttgaccgcgccgactgctctaaaatatactgatccagcacaagatgatccggctccatggaaaaccccccgccgcccattgcaataatctgcttcaatgtcatcacttctttttttctcaagtataacagctcattaaaaaggcgttatctcaatttcggataacgccttcaaaaagtatttgttatctgaaaaatacgcaccgtataacacaacggagatccccgcggcgttaatcgccggaacaagcttcgaacgggcatacttcgcaacattgatccccaacaccgtattatcactgaggggagaagcaaaccaaatgttccgctcgctaataataagctggtatgtaactgaaccgccagcgttacgccgagcgccccaagtcccccaggatgacccgataaaatgggatataacagcccccagtataaaaagagacggcgcaataaacatatgagggctccatgatgttaaatgagaagtaacatatttcgagaatcccagattttcagctactgctgttacggcccaaatcagcgataacataataataacgttgaccaattcgtttccgcccttaataaaatgggtaacaagctcgcctgcaggaaagcgctgaaacataaaaagagcaaatactgcaataaccgctgccaataatgcgcgcttttgaatggccgccccaccagctgagaaacagtgttaatagcaaaaacagcccgatcggaaagatttaactccacggccgaatcggtgtttccttaatataagcacggtgcgccgaatccagctcctcctactgcaggtatcatgttttcacaagccttggagatattttcatacaacaaaaaaggcttctacaatatgtagaagcctttgtataccggtggccggggtcgaaccggcactccagaaggaacacgattttgagtcgtgcgcgtctgccaattccgccacaccggcatataatgcgtcgtgttcaaccgacgtatataaatataacatgcattctataaagagtcaatggttttagtaaagttttttcaaatggtaatgcagtatatacgatacaagcaagaaacttatattgatagtcttcacgcttttattatataaaaaaagcgacctgcaatatgcaaatcactctcatatatgttttataataagaaaattgatgaccaatttaacataattcgctcaaagttaaattggtgccgagggccggacttgaaccggcacggtagtcacctaccgcaggattttaagtcctgtgtgtctgccaattccaccaccccggcaatagaaaggcgacacccggattcgaaccggggataaaggttttgcagacctctgccttaccacttggctatgccgccgtaatttggagcggaagacgggattcgaacccgcgacccccaccttggcaaggtgatgttctaccactgaactacttccgcaacatgtaaaagaacttaatacatcttatgctgttgttttcaaaaaaatgcaactgggctagctggattcgaaccaacgcatgacggagtcaaagtccgttgccttaccgcttggctatagcccaatgataatatggggcgattgatgggaatcgaacccacgagtgccagagccacaatctggtgcgttaaccacttcgccacaaccgccataatctgaagatgaataaataatatagtggcaggggcagtaggaatcgaacccacaccggaggttttggagacctctgttctaccgttaaactatgcccctatttataaaatggtggaggggggcagattcgaactgccgaaccctgagggagcggatttacagtccgccgcgtttagccacttcgctacccctccatcatttagagtgccggccagaggacttgaacccccaacctactgattacaagtcagttgctctaccaattgagctagaccggcaaatggtggctcgggacggaatcgaaccgccgacacacggattttcagtccgttgctctaccaactgagctaccgagcctttttataaatggcggtccggacgggactcgaacccgcgacctcctgcgtgacaggcaggcattctaaccaactgaactaccggaccatttttttggttgcgggggcaggatttgaacctgcgaccttcgggttatgagcccgacgagctaccgaactgctccaccccgcgatgataatggtggaggatgacgggctcgaaccgccgaccctctgcttgtaaggcagatgctctcccagctgagctaatcctccatcatataagtgacccgtacgggattcgaacccgtgttaccgccgtgaaagggcggtgtcttaaccgcttgaccaacgggccctggtattttttcgtttgttatgtattgataattagtggcggagagcaagggattcgaacccttgagacggggttaccgcctacacgatttccaatcgtgctccttcggccactcggacagctctccataattggctccgcaggtaggattcgaacctacgaccgatcggttaacagccgatagctctaccactgagctactgcggaatgaagtctgcctggcgatgtcctactctcacagggggaaacccccgactaccatcggcgctgaagagcttaacttccgtgttcggcatgggaacgggtgtgacctcttcgccatcatcaccagacgttttagtgacatgtattattatactatgtatttcggaaaaagcaagagtttttttaaaaaattctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacgcataggacatgctaacacatgcgttgccacaggaagtggcgcatttagcaggtgttcctatgttttgaaggaatgatccttcaaaactaaacaagacagggaacgttctgtttataagacccgaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcatctcaacctcatctcgaggcgactttttcagtataacatttcagcgatttgctgtcaaatgtttttttgtttttatttctccgccgctgtgagctttttggtgaagcgcatcagcgacgtttaataatataccatgcctatgattcagcgtcaacactttttttgaaagaatatcctcgatgatatacttcctgccctttggtctctatttgagatacttcaacaaagcctttttccgtcaggtaatcaagcatgacaccgagatcttgggtgaagtgcaccagttcagggtgctgaagcaattctccaaactgccacatttctttttctttcatcacctgaaaaaggtgcgcagaaccgatttcagcttttgaatggatgagaaaatcatttgctaagaataataattcgagccttttctccaagctttcgtgactctcgacaagttcggaatatagcttatatacctgcggctcaatgtgacggacctggttccagactgtcgtttcgggataaaacccccggtcaatcacttctatgcgggccaagtggtgaagagcgtgcactaccgcataatatgcatccagaaaatgatcagcttcaaaaaacgcttttccttctacaaatcttctgatcagcttgccgtattccattccgatctttaatttccgctcggcgaaaggaaaagtgctgagccggtcattgagttcagatatatattcattgcggtcaaacagcactttgccgttgatgatccaatctatgactcttctatttgtcccaagcagaatccattcctgaagcagagcatccgttacaatatgtaaagaagcggttttgtgttcgaattcataatgctttataaaaagaggttcatcagcctgtttcacaatgacaagcatgaccgcatcaaagttatccgtgatggatgatgctttactccttctctcaatcataaggacggccagcgtatcgggatgacttgctctttcttggtaaattggacggagaagattgtccattacgattcctccaatgcgattgtttcactagctattgtttctacatttctatgataaaacatgaaagtccttttttctaaacacattgcactattataacaaatttcctttcaggtgccatatttattcttcccttttcttacgaaaacatgaagaatatgccatatgttttgtgctatagttaaacgagagggggatggacatggcgaaatactcaagcaaaattaataagatcagaacgtttgcgttaagtttggttttcgttgggtttatcattatgtacatcgggctgttctttaagcagtctgttttgcttgccagcttgtttatgattctcggcctgctgtcgatcggactcagcaccgccgtttatttttggatcggcatgctgtccacaaaagcggtccgggtgatgtgccccgcttgcgagaaagaaacgaagattctgggcagagtggatatgtgcatgcattgcagagagccgcttacattggataaaggattggaaggcaaagcgttcgatgagtcttataacagaaaaaacagtgtaaaataaacgaagctgaccgtatcaaagcggtcagcttcgtttagtggttttcttttttggaacattcttggcagacgccgtaaatctccaaacggtggtggcttaccttaaaccctgtgacgtgagcagcaagctgttccacttcgtcaagcccgggataatggaagtccacgatttttccgcagctttcacaaatggcgtgataatggtcagaggtgacaaagtcaaatctgctggacgcatctccgtacgtcagttcctttacaagccccgcttcccggaatacacgcaaattgttatacactgtcgcaacactcatattagggaatttcccttccaaggctttatatatatcgtccgctgtcggatgtgccatagaatccacgagatattccagaatggcatgacgttgaggagtaatccggactcccgtatccttcaacgtgtctaaggcttcttttaattcatgtgcagccatccgtcatgcacctctcttctaaaaaagattcttactttataatgtttataattagtgtacatctttttccggtctcctgtcaaatgtaatctgaagaaaaccccgtgagttcagcatttgtccattaattagacgcaatttgttccaattcacgaagcgcctcggcaacgtgatctttcacttttacctttctccactccttcacaagacggccttctttgtctaacaaaaaagtggatcgctcgatacccatatattctttcccaaaattcttcttcagcttccacacatcaaaagcttccgccagtttgtgctcatcatcaacgaggagctggaaaggaagatcgtgtttttgcttaaatttttcatgtttatcacggctgtcagggcttactccgatgataaccgcatcaagtcccgcgaaactttcgtgctgatcacggaaatcacatgcttccgtcgtgcatccgggtgtcatgtctttcggataaaaatagagaacgacgtacttccctttaaaatccgtcaatgctacttcttccccgctgtcattcactaatttcatatccggtgctgtttgtccgatttcaatcgtcatttcttatacctccgggttttttattaagcgtatccaattcacgttaagattacaaccgttatcccccggctcttttctggaagcatgaacccgttgtgctcgcaatgaagcatgctacaatagaacatgatgtaaggagatattaggagggtcattttttgtatacaaaatcagttgaacttcataaggaagcgttagagcatatcgtcggaggcgtgaacagcccgtccagatcctataaagcggtaggcggcggttcacccgttgcgatggaaaaagcgaacggcgcttatttctgggatgtagacgggaatcagtatatcgattatttagcggcttacggtccgattattaccggacatgcccatccgcatattactgaagcgattaaaacagcggcggaaaacggcgtgctgtacgggacgccgaccaaacatgaggtcactttcgccaaaatgctgaaggaggccattccttcacttgataaagtacgattcgtaaactcaggcactgaagcggtgatgacaacgatccgggttgcacgcgcttatacaggccgcacaaaaatcattaaattcgccggctgctatcacggccattctgatctcgtacttgtcgctgcgggttccggcccgtctacgctcggcacccctgattccgccggcgtgccgaaaagcatcgccaatgaggtcattaccgttcctttcaatgatattgaaagctacaaagccgcgctggataaatggggttcagaaattgcagcggttctcgtcgagccgatcgtcggcaacttcggcatcgttgaacctgaagaaggatttttagaacaggtaaatgaattgacccataaagcgggcgcgctcgtcatttatgatgaagtgatcacggcgttccgttttatgtacggaggcgcgcaggatcttcttcaagtgaagcctgatttaacggcgctcggtaaaattatcgggggcggcttgccgatcggcgcttacggaggcaaaaaagagatcatggagcaggttgctccgctcggcccggcatatcaagccggcacgatggccggaaacccggcatctatcctatcaggcatcgcctgcctggaagtgctgaaggaagaaggcgtttacgagcggcttgatgagctcggcgccagacttgagcaaggcattctcgcccatgcggagacacatggcattaccatcaccgtcaaccgtttaaaaggcgcgctcacggtttacttcactgatgaaaaaatcgtcaattacgagcaggcggaaaatacggacggagaagcattcgccaagttcttcaagctgatgcttgaacgcggcatcaatctcgctccgtcgaagtatgaagcttggtttatcacaaccgcacatactgaagaggatatcgacgccactttacaagccgttgaagatgcgttcagacatatgaaaaaataacttctgaaacaagcgggagcccggggcttccgctttttctttttgtccgatttgtgagataatggttttttcaaaaaaagaccttgaataattggtatgatccctgtatattactttattgtttagcaaatcagccgacagggaaatgtaagtgtcagccgttcgttcggcacataatttattagagaaaggaatgcacgcacaaaccaatgaaacttggtgcccgcatttttaaaacagggattgcgattacgctcgcgctctacttagcatcatggatcggacttccgtcgccgatctttgccgggattgcagctatatttgccatacagccctctatttacaggtcttttcttatcattattgatcaggttcaggcaaatatcatcggcgctgtcatcgctacggtattcggactgattttcggaccgagtccgattatgatcggattgaccgcagtgattgtcatcacgatcatgttaaaactgaaaattgaacacaccatttcgattgcgctcgtgacggttatcgcgattttagaaacaccgggaaacagcttcctgacgttcgctctgatacgaacaagcaccgttattttaggcgtgctgtcttcttttattgtgaaccttgtgtttcttccgccgaaatacgaaacgaagctgactcatcatacggttgaatataccgatgagatcatgaaatggatcaggctgacgatgcgtcagtctacggaacactcgatattgaaagaggatattgagaagctgaaggaaaaaatgatgaagcttgatcatacgtaccttctttataaagaggagagaagctactttaagaaaacgacgtatgtaaagtcgcgcaagcttgttttattcagacaggcgattattacggcaaatcgggcgcttgatacgctgaaaaagctgcaccgctatgaaaacgagatttatcatatgccggaggaatttcaggagacgctgacagaagaaattgattatctgcttcattggcacgaaaggattctgatgcggacggtcggcaagatcaaaccgcatgatgacgatgctgaagaaagcataagatataaacagcttttgacgaagtctttcttgaaaaatcagcagaactgcgaggatgaactgcttgattacaatatgctcagcattatggctgcggttgcggaataccgcgagcagctggagcatctcgatacgctaattacgagttttcagacataccacccgaaagacagcgaattagaaacagacgaagagtaacccggtgcttccgtaaaaccgggtttttttgcattcaaaaaacgtatgccgcccattcggacggcatacgtttttgtatcagttcaaattctgaatcgtaaataagtgtctgtactggccgccttgggccattaattcctcgtgcgtgccggtttcgacgacggcgccgttttccatgacgacaattttatccgcgtgcgtaatcgtggacagtctgtgggcgacgataaaagtcgtccggtttttcgcaagcttttccatcgcttcctgaatgtagtgttcactttcaagatcaagagccgatgtcgcttcatccaagatcagcagcggcggattttttaagaatacacgggcgatcgaaatccgctgcttctgcccgcctgacaatttgacgccccgttcgccgactttggtttcgtagccttcggggaagttcataataaattcatgggcatttgccgctttcgcagccgcaaccacctcatccagagacgctcccggtttaccgatagcgatattttcacgaatcgtctcactgaacagaaacgtatcctgaagcaccattccgacttgattgcggaggcttctcgcttcataatcgcgaatatctgtgccgtcaatcagcaggctgccgccggatacatcataaaaacgcggtatgaggctgacaagcgtcgattttccgccgccgctcatcccgacgagcgcgacggtttccccttttgtcacctttaaggaaacgtcctgcaaaatcgtttcttttccttcctcataacggaacgagacatttcggaattcaacttcacccttaatgccgtcagcttttaatgcattcggtttatcagtcagttcatacggctcgtcgataaattcaaatatgcgatccattgaagcgatcgactgggtcagcgtcgtcgatgagttgatcaatcttctgaccggattgtacattctgtcaatatagccgacgaacgcaaccatcgtccctaccgtcagcgggccgtttatgacaaaataacccgcaaacgcgataacaagcagcggcgccaaatccgtaatggtattcacaactgcgaacgttttcgcgttccaattcgtatgacggatcgctttgtccagaaaatgtccgtttttttcatcaaaattggcttgttcataatcttcaatggcgaaacttctgataacgggcatcccctgaactctttcgtgcaaatgtccctgaacttgggcgagtgcctgagaacgctcacgtgtcagttttcggagacggccgtaaaagtatttcactgaaattccgtataacggaaacaaaatgacagatatcaatgtcagcttcacatcgagtgtaaacataatacagatgacgatcagcaccgtcatcatatcaagccagatattcatcagtcccgttatgacaaagtcttttgtctgttcgacatcatttatcacccgggaaatgacttcgcccgttctcgtgttggcataaaacctcaggctcaatttctgaatatgatcaaacaatacccccctgatatcgtagagcacccggctgcccgtccattgtgcgaagtattgccgatagtactctaccgggggacgcagaattaaaaacagcacgaacatgatgcccattatcgtgaatagcgatgatgttttagcgcttgccgttccgctcccttgaataatgtcatcgaccacgtattttaacagaagcgggagagccagcgggatggagaattttataatgccgattaacactgtgataaaaatttgttttttataaggttttacaaattgcatatagcgtctgattacgcccacactttatccccctctctctttaaggcgtgtgagcccatgtgaaaaacctgttgacaccccaacaggttttttattgtattctttattttgtatagcgcagataccgttcataccacatatcaacaaattccggagcaaacggtcctttccgctgatgaatccaatgcagcagcgtattcagatactccttcagaatgctgtcgatctctttagggtaattcattgatttgcggtggtcatcgtattcatcctcgtcaagaatgttatacgtcatatccggaaacaccttgacatccaaatcgtaatcaatatatttgatggcctctccgtcataagcgaacggcgagctgatgttgcaataatagtgtaccccgtcatctctcagcattccgatgacgttaaaccactgacgggcatgaaagtagcagatcgccggctctctcgtcacccacgtccgtccgtcggattccgtcaccattgtccggtcgttggctccgatgatacacaattccgtactttttaaaatcgtcgtttcattccaaattcgatgaagcagcccgttatgcttatagctgtgaatttgaatggtttctccttccttgggatatcccatatttctcccctactttctgtaaagccctgcagtcaatgcagccgcaattgctttccgacaagtcttttcactattataacgttacgaattaaaaaatgaaaataaaagaaccactccgcttccggaatggcacattcatttctgcacataggaagacggcttttccgtgctgcgataagactggatgacttgctctgtctgcctttggaataactcctgtatgccggccaggtcttttcgctttgtcgcaatttcgtcctgtacattgtccagctttgcatctctttccagactgatgagttccgcttccacctgccggcagcggtcaagttctgactgcagctcgagaagctgatccatgattttcatctgttcacttacaagcttttcaaactctgacatcgggttcctccttaggctttaggttgatactccttaccatttcgattttacgccggaaaaccctttgactcattctgtagaggaatcacaagttttgtcgttttagcaacagaaaaaagcacttccatccgaagatgaagtgctttttcgtttcagtgattagctgttttgctgtttgttttgttcagcagattggttttgctttctaacctgctgcgcatcagtttcactgccgaattcagtgccgtattgaccctgaccggaagctgattgctggttttgtcttttcacctgctgaacgtctgttttgctgtattttgagtttgccattgttatcacctccacgcactttagaatgcgcaggagacgataaggctattcatctttttttaaaacttatacgagcagagagcgtccgccgtcaataatgatggtctggccgcggatcatgtccgcttttgaagaaactaaaaactccaccgtgtcgatcatatctttaatctcgaccattctgccggccggcgtattttggcgggcatcttccagcagttcatctctgttagggaaatgcttcagcgcgtccgtatcaatcgctccgcctgacaccgcgtttacgatgatgtttttcggagaaagctcaaccgccagataacgggttaacgattctaaagcggcttttgagacaccgaccgtcgtatagttttcaagatagcggatgctgccgagcgagctgatgctgacgatgtggccgcctccgtttttctccatcatctttgccgcttcctgggcgcagaaaagcaatgctttcgcgttgatattcatcgtccagtcccagtgtgtttcttcgagttccataaccggtctcagcacgcctgaagccgcattattgacgaacacgtccagtctgccgaatgtttcgtcaatctggcggaacatgtctttgatttttgccggctggccgacattagctttaataacgagcgttttaacgccgagtttttcaatttcttcggcggtttctaatgccgcttttttactgcgggcgtaattgatgacgatattgtatcctttttccgcgagtctgatggcggctgctttcccgacgcctcggctgcttcccgtgatcagtgcgcatttattttgttccatttttcctcagctccttgctgtgtatagttcttttcattcaacaaacaataaaagcaatatctgttgaaaggggtcttttatatgtatgtcggacgtgatatgggcgaattggccatgatgcccaaacaagattggagagattcagagctcgcctatttccatcatgccttccagcaaattatgccgtatttaaacgaagaaggccagtccaaataccgggaactgattcaggaaatcgaagcccgcggcggactgaaacggaatgaagcggattacggccacggcactcgcgtcagctatgactgacgctttttagcggccgctttcttccgccattttccatatcttttgatgggaaacgggaaatgcgtattccttgagctcctcttttgtgacccgtatgaattccgttgtatccgacacttgttttactttaccgaaaaagaccgaaatattccagacgagatgggtgaaaacatgttctacgatgccttccagctccccgatttcagcggttattcccatctctttttctaaataggcttcaagctgctctctttcggttttgattcctttctgggtttcggtattcggaaactcccacaagttggcgagcaagccttttggcggccgtttatgaatatagacatcgccttgttcgtctgtcagcacaacggctgccattgtttttattccgggctttttctttttgcttttaacgggcagctcccgctctgtcccttccgcaaatgccgaacagtgcttttgtacggggcaaagcaggcatgacggtgatttcggggtgcagatgatcgcgccgagctccattaaaccctgattgaattcagatggtttttcatgagaaatgaaagcggataccgcctgttcgaaaatggttctggttttaggttttgcgatatcgtcccatatggaaagaattctcgacatgacacgcatcacattgccgtctacggcgggaatcggtttgttgtatgcgatgctgagcacggcgccttttgtataagggccgacgcctttcagtccgccaaattccttttccccggcagggacgactcccccgtaccgctcatgtacttcttttacggcactttgcagatttcttacacgggagtaataacctagcccttcccaggctttgagcactttttcctcatcggcttcagcgagcgccgaaacggtcggaaattgctcaacaaaccgccggaaataaggaatgacggtatctacgcgcgtctgctgcagcatcacctctgacacccacacccgatacgggtcctgattttctctccacggcagaattctctgttctctttcgaaccatgtaattaagtcctcgcgaaatttgtctatatctttttgtttcattttttcttcaagtgcgttcatatcttctcctcagatgtttcgggttccgcttttcttgacactgtattttggtgtaaactaagggcacgttacgataatatgttacattaaatagtgataaagaaaaagcggaaacatatgagaacggcggataaacgccatgattgggcaaacagaaaatggggaatatcttataatgcgaaatatgcgggcggctgatttttaacgcctgctaggaggtcaacaatggatactggcactcacgttgtcatgggtatcgcgcttggcggaatcgcaactcttgatcctgccgtcggcatgcacaccccaatgtctcaggcagttatgatcgccgcgcttgccggctctcaggcacctgatattgataccatattgaagctgaaaaataatgccgtttatattcgaaatcatagaggattcacgcactccattcccgccgtattattttggtccgttctgattccgggcattttgtttatgttttatccggaagcgaactttttgcacctgtggctgtggacgcttctggctgtcgttttgcatgtgtttgttgacatttttaacgcgtacggcacacaggccatccgcccgttttcgagaaaatggatcgctctcggtttaatcaatacctttgatccgtttattttcgtcagccatttggccgcgattgccgtttggtatatcggaggtcatccgggcgtgacatttctgatgctttatatcatccttgcaggatattacgccgtccggtttttgatgcagctgcggataaagcgaaggctgcgcgaaatgattgaagaggagattgaaaccatcattatttcgccgacgatgaaattcaggcagtggcgtatcgccgtgacgacggcccatgccttttatgtcggcagaagccttgacggccatgtcgtgatattggatacattcaaccgcgtgcccgttccggaaaccgatgtgatgaaggccgcgaaacaggacgaaaatattgcagcctttctttcattttcccccgtttacaggtgggaggtcgatacttttaaagatcattatgaggtgcgctttattgatttgcgctaccggagcaaaggccactatccttttgtcgccatcgtccacctcagtcatgatttagagcttctctcttcctacacgggctggattttcagcgaggaaaaactgcagaaaaaattaaagctcggctctgtttaagagccgggctttttttgtcttctcacatataatgcggcaaacacgaggctgatcaccgatagagcggccgcgggtttaaaaaacggcgggtaatacgttaattgaatatcgttttttcctttttgcgctttaaatccgataaaggaataatccgctttttcaatctgttcttttctgccgtttatcttcagctcccagcctttttcatatggaatcggaagcatgatatacggcgcgctggttttgttttcatacgagatatgaagcgtatttccgcgccatctgagatcggcccgcggttctttttccgcttttcggtatgcgtttttcagcgtatcgtaccgttcttcgtaaagcgccagcctgtcaagctgatacgatcctttcggcagacggatttggatgttttttgttttcggcactctgacagtaagatcgttgacacctgttttgtaaatggattgattcgattttctcgttgtcgtgtaatcgttcacttttaatgtaaagccctggtccttcgctttattcttcaaataaaagctgacgtaataatcgccgccgtccatcttagcggcttgcggcgtaatgatcaggccgccgccgtcttcatttaccgtcaggatgccgtcttgataatccgcatggtcggccgttacctttgcctgacggatcatatttttcgcctcaggcgcttttttcgtgttggctgcgcttgattccgtgatgatcccgtcaagcattgcccgttctctggcaagggagggcgcttttttcagaccgtcctcgttatatacgcgatcagctgtccgtacgaacggaagcatatattgattttgataaaccgcataatgggatgattccatgatttttttgaacccgtacggcacgccggccccgtttgttttttccgtcatataatattttccgtaaagcaggctgtataaattagccctgtttcctaatgtcgcataacggctgacgctttccctgcccatgtcaatccggaggtcgttccagtaaaaggacagcagattgcggttcagtatgcttgaatatacgctgaatccgttgaacccgtatatgatcggagtgttattgaaaacaccgttcatccaatccaaacgggcaaacggatcagggtctttttctttcaggcgctgaataagctctgtttgttctttgcccttatagtcaggacccgtcataaaggtatgcgataccgtataaatcttcccgccttctgataacgcatatttttcatatgtattagccgtcagcaccgccgtcaagagaatgacggcatagacggcggacaccgcgcctttcagtcttgtctttgctgcaaggaaagcggcaatggtcagccccagaaggagcaggataggcaggttggcctgatcagaaatatccaggctgaaccgtctcacttggctccaatagagcagaacggcgagtacggcggatatcagcatactcttcatgctgatgtctgaaagcttagaaagccctgctgcaaccgttccggcaatcgtgaagcacaggacgtattcaaacctgttttgcggagctgaaaaaccgttaaaggcgcttgccgcaaacggactgaagtgaaacagaatgtacagcagactgattcccgcaaacagccggaacagccggtttttatataaagaaaatgtaaatagaaaaagtaaaaaaaccgccggcagaatgattatccggcttgaaaataaaatgttgtcggaaaaatcaagccatgcaatttgctctgaatacggcggccgcagattatgaagatatccgtatacgacagggataaaggaaactgcgcttatgccgaacccgagaaggcccgacagaataaatatcctgcattgagcgagccttttcgcctcattgccttcaagggggatcatccacctgaataagatataaatgccgatgaaaatcagattaatatacgcaaaataaaagttgttgatcaatgtcagcgcacaggcgaagataaaccacgccggctttttttccctgatgattttttccgcgccgagcacgagcagcggcagccacaccatactgtcagtgaaaaagtcccaatacacctcatgccggaagtagataatcgagaccccgtacaacacggcgccggcaaaagcaggcaccgtccgtttgacgaaatagcggaacacacacgccgccgtgaatatgatgaaactctgcttggcgatgctgataaaaacggaggcctgcgcccaaaacagcgcatcagcctcacccgtcagctgaataagctgcaaaaagcggacagcggcggagataaacaggaatagaaaagaagtagagaaataatagccgagctgactgtacactcccccgcccagtccgaacgaatagctgtaaaacagcctgccgttcatatattgatcaaacagcagctttttgaagaccgccatttgggcgatcccgtctccagaccccgtcatatagcggccttccgaccactcttttaagaaaaaaatatgagcggctgccgcagccagcacacaggctgccggcaagatccatttattttttttcatacaacgtccccagaccctgcgcacagcggcggctgtttaatggttccacttgcgcttttttgtataattcgtttcattttgttctccgtacgttatattcgcttctttaattaaatagtgcgggcgtttttttgtttcatagtaaatccggccgatgtattctccgatgatgccgagactcaaaagctggatgccccctaaaaacagcacggcggaaataatggtgaagtatccgggtacggacacgccgtgtgtcagaatatgaacaaaggtcgttacaatataaaccatcgacagaagcaatatcagaataccggtgaaaaagcataccctgaggggcttgttgttgaaggagacgacaccgtccattccgtagttgaacagattgctgaatgaccatttggacgtgccgttcttcctttcgacattttcataaaatacgattttctggtcaaacccgatccagcagaacagccctttcgagaaacggttcccttcactcagcttcaaaagggcatcaacggcctgccggctcagcaggcggaaatctccgaccccgtcacgcaagtccacttcgacggctttgttgataaatttataatacagggaagaaagcacggaacgcacggggctgtccccttttcggttgcgctgcgcgatgacttggtcatacccttcttcatagccttgaatgaagtctttcagcagatgggtcggatgctgcagatcggcgtccatcacgattaccgcttcgccctgcacgtgttcaaatcctgccaaaatggccgcttctttcccgaagttgcgggaaaaagatatgtatttgacgcgatggtttctggcggccagttctttaatctgctgaagggtgtcatccgcgcttccgtcattgatgtagaaaatttcatagtcataatgaatcgtctgaaattctttttttaaagattcatggatgagcttgacgttgttcccttcattgtaagacggaataataattgagattaacctttgtttcatgaaggcaccttctttgtattattctttttttaggacggccttaaaggaattgtccgcaaaacttcagtaaggcttttcctttttttaatgacgtttaaaccctttttttgttacagggaaagaaatttttttctgcatatgatttatattttgtcatgtttttcggcagatatgagaaaaaaaagaaaaagtctgtacgcgggacagactttattgctgaaggtattcatgaatcaaatggctgacgatgcgcggtttttcgtgaatgacccaatgtgaggcatcatctatgaagattaagtcgccgtttggaatcatccgttttgtttccttggcgagctttttgctcagcgcgcggtcgttgacgccccatattaaccggtacggaacgggcattttaagcggaacggcagggcctaaaccgccggctctgatcgcccggtaccagttcagcatcgccgtgagcgctccttttctgccccatgcttctttgtagctgtcgacatcttcccgtgaaaaaagcgccgggcgttcagataagccgatcgcgtgatccaatacgcggtaatcgtcttcagacaatctccgttccggcttttccggaagctgaaagaaagcgatataagagcttttcttccactgcggcgggtagaacggtgtgaccttccgcataaccgccgggtgcgggatattgaccgtgatcaatttttcaacgttttgcggccgcgtggatgccaaatgccaggccacggctcctccccaatcatgtccgatgacgacggctttgtcatctgtaaaatgagtgatcagcccgataatgtcgtctctgagcgtatcaatggtatagttttcaatgccctccggtttgccactgagattatagccgcgctgatcaggcacgacaacatggtatccggcatccgccagcggtttgatctgactcttccagccgtaccagaattccggaaacccgtgcagcagcaccgccaaaggaccgtctttcggaccggctgaagccgtgtgcagcgtcactccgtttgtttcgatcatgtgaaacgtaatgtcattcatcgattctcctccccgtttgtttcaatcttctttctgttaagacgatgatcagtacgctgatcgcgatcaacaatacggcctgaacgatcagggcgaacggctgagtcagccggataagcaggctgcccgcaaatccagctgccgccgaaataaggccgaacagaatcatgaggagcgcactgaatcgattgccttctttccactgcgactcatccgccatagagcgcttcgtccgatatccgtacaggctgttgatcgacttcggcggaaaaaacgtgactgaaatgccggccgcagccatcagaaggccgccgattaccattatcatatccgtcactctccttttcatcttttacgaaaggaaaggcgaaaggtttcagaaaaaaagcaggcttattcgcccgcctgaatctttacttttgagttaagtcggccgtttttacataacctgctttcccggcgtatgtgacgtacgcccatttacggtcaaatcctccgtcatggctgaacccccagccgagcacattgacggtttcacccgctttaacagacccttttttgccggtttccaaagtcggcgtataaaaatcggtttgtttcgcggtcaccgccttcaccggctgcttcatcagaaaatgcgtggaaatataggctttgtgacctttgtagtcaatttcagcccaatctgctccttgaagccgtttaacctttacggaatcctctgaacgaagcgtgccgataatccgcccttgtttattgggttctttgcggacgttaagttctcctgctttcacgatatatgtatctgctgcggtgtctatttttgtctgatgaactgctgcggcattcgctgccggatcaaaaaaaacggtgcctgcggctaaaaataagcaaagtcctgcggccggaataaatgcggttaacccctttttcatgttcattgtggttcctccccgctattttataagttattacacatttccacattccgccggtcgtcaaacatgattttcccatttcttttataaaaagaaaaaaccgccggacggtatccggcgggcgcactgctatattaatgcaggagacccctgctttgatccaaataatgagaaacgtcttcccgaacgctttggaacatatggagcttgctgccgtatgattcgatccattccttgacgacgcgttccgtcatttgctctccttggtacgggcggccggcttttgcgtaagtcgcttcgaaatctccccataaaagctcaacccaagtccgcgcttgcaaatagctgagcatgtcatttttctcaagcagcaaattcgtcagtttgtcgatatatgtattcatgtctctgtctcctttccttgggaaaacctgctgcttttacgcagcttgtcacaggcatatactaactttacgtcttcagtccagaaggcgcaaccttttgatattggccgagggggaaaacaaatggtccggaacaaggcaaaaggatttcctaatcagaacaataataagtttgaaggcgaaccgcgggcaaaggatgactacgcttctaaacgggcggacggttcaattaattcgcacccgcaagagcgcatgagagcttcaggcagacgataacacacaccgtaagagaccgggaatgacccggtcttttttttgcggaaaaaaacatcctcttgcggtcataacgctaaataaattccataatatgttaaatgctaaaccgcaagccggtagacaaaaaaggaggggttttataaaatgaagacagtttcaaaacgattgctgagccttaccgcattcttactgtcagtttcattatttgctgtttcagcagaagcagcgggcagcccgcagacatctgtatcaaacagcggtgaggagtttgacgcaaatcagaatcagcctgtacaaacaacacagacatcccccgcttatgaaggaacgggcctcaccaaaagacagcttgcacaaaacagcaaagctgacatcaagtcattaaagccttccagtattattgggacagacgaacgaatcagaatttctcccacaacatcatttccatatcgcgcgacagcacagctgaccgttacatacagcggcagcacaagcacctacggatgcaccggtttttttgtcaatgctgacacgatcgttacggcgggacattgcgtgtatgatcagaaaaacggctgggcatcgaaaattacggcagctcccggccgcaacgggtcatcgtacccgtacgactcttattcaggcaagacattctacagtgtcaaagggtggacagaaaacggtgacacaaactatgactacggcgcaatcaaagtaaacgggtcgcccgggaatactgtcggctggtacggctatcggacgaccaacagttccagtccggccgggctttcctcaaccgtgacagggtatccgtgcgacaaagtgtccggttccatgtggtcggacagcaagccgatacgttctgccgagacatataaactcacttacacgacagatacgttcggctgccagagcggatcgcccgtttaccgcaattacagcgacaccggccagaccgccattgccattcatacaaacggcgggtcgtcttacaatctgggaacaagggtgacaaacagtgtattcgacaacattcaatattggtcaaatcaataaagcttttgtcttctttctcgcggcagccgttttatgcggatgcggcaaagcggatgattccgccgccaaaaaagcactgcccgttacgctccatgttgagaatgcagacggttcaccggcggccggtgtgacggttaccgtgatgaaagcggcggagtcagatcatcagccgaatatagaccgcggagagataataggcaagactgatcaccacggtgagatgacatggaaaagcggcgcgaaaggaacctatgccgttgtttttgaaaaagacggggtaccggaaacccggaatatttccttagctgagagcgataaacatacggtgatcagcattacgttgaaacattgaaaaaagcttgcaggcggaatatcccctgcaagctttttgttatcctttatgcacttggtattcataaacatctttcttctcagacagatgagcgaacgtggaaagcacaaggccgagagccgtcatcagcgcaccgccggcaaacagccatgagtaagatcccgttcccccgagaatcaatccgccgatccaggcgccgagcgcgtttgccaggttaaaggcggaaacgctcaccgcagcggcgattgtcgtgccgttttcagaggaggaaataaccttggtctgcaaaagcggcggcgtgccgaacgcacatgcgccgaacaaaaatgtcgctgaaacggctgcggcgggaaaaacagcgatataaggaaaaatcgccaagacgccgatcaggccgatcatcacaccgatcatcgtgcgcgtcagcagtttgagcggcactttccccgcgaagaaattccccgccactccgccgagaccgtaggcaaataatgcgcctgtaatgccgactgtgccgaaccccgctgaatctcttaaaatcggctcaataaacgtgtaagcgataaagacgcctgagtagccgagaatggtgatcgcaaaggaaaaaatcacttgtttatgcttaaagacactccattcattcatcagcatcggaatcactttcggttttcggttcggtacgaccagcatcagtccgatcagcccgatcaggcctaaaacagaaataatgaaaaagacggcccgccagttaagggcatcccctaaataagagccgaacggaacgccgagcatcagcgccacggttaatccgccgttcatggaagccgcggcggcggaacgtttttcaggcggcaccatttcacttgcaaacaccatggcgatcgcaaaaaaagctccgtgaatggatgcggataaaattctggaaatcgccagcacggcgaagttcggcgcaaagacgctcatcaggttggcaagcacgaagatgcccatcaaccctagcagcaccggctttctcggcagcttaaccgcgataatagttacgatcgggcccgtcaggcagacgcttgccgcgtacgccgtaacaagcatgcccgctgaagatacatgtatatgaaagtcatcggcaatcgacgtcagaatacccataacagcatattccgtatacccgatggaaaatgtgcaaatcattaaaacaaaaatcattaatttcacagatggctgtttcattttgatattcaacgcaaatcgcctcctttttattaaaaaacaacgaattccatcttaaaagatatcaaaaatgaattcaatcattttttactgaaaggttgaaacgaatgtgcccgaaaagaaaaagaggccggaaccggcctcttttgttattatttttcttttaaaacggaaatcggcagtgcttcttccccgtcagacggggaagatctgtgtccccaggcgaatacgccgttgatgtaatcaatgcggaaagtgtcatcagaaccttctatctgatacaccccgccgggccgaaagtcttccgggttcagcatgtaagctttggccatcgtaattttccgttcaagcacggccagttcatttacaatgcccatctgttccgctttacgcgctttttccgtcagtcccgcaatttctgtctgtagttcatgaggcgtcatttgactgtatcgtttgtccatttcagtttactcctcttcctgcaagaattgatcaatatcgtcaatcgagaatccttttctgaataagtactgtttgaccttcattccgctttcatagctgccgtcatagcggtatttcctgatcgctttttccgcatgagccttcagagcttccatctcggcttcatcatcattttcatactccgtctgctccagagcggcattgatgacgtcgaaagggaaaccttttcgctgaagctgcatctgcgcccgctgtctgatctcttttgtggacagctttttgtcttttttgaggattttgccgatatgtttcagcgcttcttgtatctgctcatcaaatgtaaacgcgctgagcgtctccttgatggtatcgtcgtctattcctttcgctttcagctcgcggaacaggacgtcagggcctttgccgtttgtttttttgtgggtgctcgcataggcttcggcaaattctttgtcatttaagtagcggtaatcgtacagtttatggatgacttcagaaatgaccatgtccggtgtttcttttttcttcaggtgatcccggacttctttttcagaccgcatccgatatgataaaaattcaacggcgcggttaaaggcttttttcacgtcatcaccgtgctggatttcaagaatgtcaagctcgtccagttctttcccttttttcaggtcaaaacgcacaagcacgtcggcgtcgacgctgaatgcatatttctcatcaagaaagatgttgaagcgctcggtatttttcttttgggtcgatatttttgtaataaacggcatcccggtctccttccccgccccgatgttcaggcgtttttctttttggcaaatgaggtacagtatatgtatcaacgtgtaaggagagatggatatgaatatcgcgatgacaggcggcactggttttctgggccggcatctgacaggtgtgtttacccgccggggacatcatgtctatattttatcaagaaaacagagagaaaccgaacaaaaaaatgtgacatatgttcaatggctggccgaaaacgcggcgcctgagcgcgagcttccccctattgatgtatgggtgaacctcgccggcaaatccatctttgaccgctggacggacacaacgaaggaacaaatcatttcaagcagaatagaagcgacgagagaagtcagacggattatgaagcagcagccgaaaaaaccccgggctttgattcaggcaagcgccgtcggcatttacggcacaagcacagagaaaacgttcactgagcagtccgatacgtcaaatgaagactttctcagtcatacggctcatatgtgggagcgtgaaggccagaaaattgaagcgctcggcatccggacggtatatgccagattcggcgtgatgctcggtgaaaaaggcgccctgccgctcatggttctcccttataagctgttagcgggcggcaccgtcggctctggacggcagtggctgtcatgggttcatgtcgatgacgccgcggaacttattgcttttgcggcggagcatgatgacttgtccggtcccatgaatgtgacatcgccgaatcccgtagaaatgaagcaattcggaaagacgatcgcaagcgtcctgcaccgcccccattggattcccgtaccggaattttttctggagaaggccttgggagaaatgagcctgctgatcgtaaaaggccagcgcgccctgcctaagcaggcgctgacatccggttttcagtttacgtatgaagaacttgagttggctttaaaggatatcttatctgcataaaaacggaaataaaagccaatcctattggtattctgttttgaaggagggtcttcttttatggaaaagaagcgcgaaaaacatcagcagggagccaatctgaaaaaaatgcaggaagtcctttattccggtgaatttaaaaaagcggaaagagcagccaaacggaaataaactgaataaagatcggggccgggcagatactatgtttgtttgatatcacttttttcagggggcgattgatatgggcagaaatcatactcacaaaaaccgtgataaaaacaaacaaaaacttcctcaagttccggatgctttgaaacgcgaaacagacggcacgtacgaggaatattcaagcgagcttgctgattccgctgaccgcgaagcgcaggcgcggatgaaagccgctgacaacagagctaaaagcaaaacccgctaatacgaaatccccgcctctgtatagagacggggatttttttacaactcggtaaacaggctttttgccggcgtccgttctttcgccttaggctgttcatccggatagcccgtttgaatgatggcggcgaagcgctcattgtctgccagaccgaagtcttggtgcacctgtttgtcatacatgatgcggccgcttttccagaccatgccgatgccgttttcatgtgcgagcagctgaaggttttgaatcatgccgctcagcgccgcgaaatcatcgtttctcgtaaattcattttcatcttcttttaagacgacaagcaaaaatcccggaacggcgctgaggttttttctcatgttccgctctttttcctcgttgaaatcatcttttatttttttgaaaaatgagacgtagctgtccgcaagcttttctttacccgcttcgcttgctgcgtagataaaacgccatggctccgtcagtctgtggttcggcgcgtaaacggccgtttcaagcatatctaatatgacttcagaaggtacggtttccggcttaaacgaccggatggatcttctgtttctgattgtatgtgcaagactttcgttttgctgtagttgttcggttttcggcatgccgattcaccttcctattcaattgaaaatgattatcatttataatataacggatacgaccgtcttttgtaaaccgttacggaagctgaaaattgattgattcggcatacacggccgttcccgtcatctcgattttcatcttttcgttatcttctgtaatcctgatttccacttttccgtctttcccgatttcctggccttgttcaatcgtgaggcattcggcttcagagcctccgtattgccgcatataggccgccataacgcctgaagcggttcccgtgacgggatcttcggtcgttccggagaaaggggaagaaaaatggcgtccgtgcagatcactttccggatgaacggtttccagagaaaacggatgaacgctcgctttcggaagatcgcgcaaaacagcggggaattgtgcgttgtccggcaccatattccgtgatgcttgaagtgatctcagcggaacaatcagtgtccagatccccgttgatccgtaaacaatcggcagctcgctgtgaaaatcctcagccgtaatcccgagcgaggccgcaagcttttctttgtctcccgtaaacggcagaaattgcgggggtgcctgttcgagcgtgatgtatacccggccgtttcgttcagcggcttttgcgggaagaataccggcttttgtctcaatttgatatgtctgatcagcctgaagccttcccttttcaattaatgcgtaaagagaggcgacggtagcatgtccgcataaattcatttcgtggccgggtgtaaaatagcggatgcgcagatcggcttctccgcttttgcagagaaatgaggtttcattgtaccctgccatttcggcgatcatctgcatctcttcatctgaataatcatctccgttaaagacgattcccgcgggatttcccaaaacaggaatatcggtaaacgcttcatatttaaacacggttgcctgtttcattcatcagccttcctttcaccttatgatcatgttattcagtataacagagtaaaattagaatttttagttaattcttcaaaaaaaaagacgccttttaacggcgtctttttttggtttttccgatcaggcgggtgacgagaatcatcgtgacggacagcgatctgtttttacggtacgccaagtatttcccgcgccactccggtttgtatttttctttaaaggcccgcagcccgctgaagctgtacatataccggacgttgttgaaaatgacggccgcgattctttccgaccagaaagatgtaaaagccgttcctacgtttgacaaaggcgccatgcccatattaaaggtggtatagcctttttcctgcgcccagagaaacagacggataaaaagcgcgtccataataccgttcggcgcacttttccgataacgcatcaagtcgactgatatctcgccttcctgatacatcggcatcaggttggcaaaagcgatgatctccccttccgcgtctttcacgtaagcaatcggcgcctgttccagataatcccggtcgaagaaaccgagagaaaaacctttctcttttttcggtccgagccattcgtccgatatgtctttcagcttggcgataaactcggaggaaaacggcggttccccgacatgaaatgtgtagccttcgcggtcaaatttgttgttaatcgcccgcagccccgcttttttcttacctgacagcgtaaatgcttccatatccacgaacgcctcttctccgagcttgaagaagttatagccgaagtcatggtacagcgccagatcttcacgttcgatctgataaaacatgacactcagcccctgcttatgcgcttcattcagaaattcctcaatcacaagcggaaaagagtctctctgtcctgacggatcaccgagcacgacaagccttctggaaatctggccgaacaataaaagcgctttgccgtcgcttgagaaataaaaccgcttatccccgagaaagccgagatggctgagggcgtttccgccttcttccgccaaaaaggacttcagccgttcagggtcggccttttctccgatcggcttcgatcttttatgataaaagaccgtaaacaacaggaaaaacagcggcacaacaataatggccgtcatcgtggcatatgtaatgtgcgaattgttatgaacgaaataatcgtggcgcagcagccgattcattttatcccagataaagccggcaatgagattgtagttaaacaaggcgataataaacagagcggccgcaaaaatcatctggccgagcgtatacgatgcctgctctctgataaactgccgctttaacagcaccagcaatacgatgacgacaggcagaataaagatcgcgctgatgttcaatccttttaaaaaactgaacacaaaaccgccgaccagcgcggcaaccgccattgaataagaacgtttcgtccgtttgtataattcaatcggcaagattaaaagaatcaaagccgcgcttaacgataacgcgttaaacgcaaggagcgccgggcgcggaatatgcgggatgaccgtctccctgtcaatcggcagggcgacggatgccagcacaacgactcccgccatgaaaactaaaagcgacagcgaaccgtaaagcactctgattaagatggcgcgctggaatacgagaagcacgttcgtcgtttccacggcgggcgccatcttcggatttgattccagccgtttaagcgtattttccgttaaatcgccggccgcaaagaacagcccgaacacaaacggaataaatgaatacacaatccggtagatgacgatggatgtcacaaccgcctcctgcggaaagcccatattctgcataccgagcagaaacagaaggtcaaacgaaccgaatcctcccggcacaaggctgatgattcccccgatagcggcaatggcaaatacaccgaatacatggcggacatccgcgtgaatccccatgacatacagggaataatacatgacgacggccgccgcaaaccattcggcaaacgatgccccgatgtaagaaaaaaccggatgcctcggttttgcttcaccgtcttctgcgcgagcttttttattgttgacccaagcggcgattaaggctgccggcacaataagcgccactccggcgattacagcccacagccacggtttctcacctgtaatctctccgaccggcagaatgcgggcaatggtcaggatactgaagacggacagcccgagcagcgctgaggacgtaagccaggcgatgcctgcgacaaggcgttttacgtcattcgtatgctctttgtaaagcatcgtccgcagcccgacgcccgccagaccgccgaatccaaggacattgttaaaggaattggcgataaaggagaccctgaatactttccaattcggaatgtcgaggcgaagcgtccgtttcagcacaaagtcataaaaggacatcgcgctgacggcaaggagaccgagcagaacgagaataaataaatcgtaacgctcaatcccgttaataatatacagcgttcgtttaaaagaaaggtctgtcaattcctttttggactgataaatgactaaaagcaaaactgcaataggaaataatacttttaatatcgataaggcattctttttagtcagcaatgttctctccaatcatcataaaatagcttatttattataattcccccaataatctccaacatattatacactaccacctcacattcaaacaaaactcgtctgcaactttctttctctgattaaaatcagtaatatggtatgcaggagtatgaatgaggaagtgagacgatggattataatctgcatgatacaacggtattaggcggcgatattttttctcctgaggaacgggatatttgggtgctgtacatgaaagtgatgacctcggcgggactcggcgatgtgtcggagtggatgaagcttgatatgagcatgccgcaaatgaaggtgctgatgcttctgaacaaccacgggacgcttaaggtgagtgacatagcggagaaaatgggcgcttctctttcaaatacgacggggctccttgaccgtttagaaaaatcatgtttcattacacgcgctccgtcagaagaagaccgccgttcagtcgtcgttcaattaacggaaaacgcgaaagatattttccgcagcctttatcaaaaaggacatgtaaaattgaagcgttcattggaaacgctgaccgctgaagaaaaacaaacggtcaatcaaggacttgccatcttggcaagagcccttgattcttccaaacaggcatagagatgaaaaaggcctgccggtatcggcggcctttttttgtttgacatttaattcacttgaagtgaataatatattcgaagtgaattaaaaaaggaaggattgatcagtatgccggatccattgcaaacagaaaaaaaccagagccgggccatcactctttttacgatcggtgtgttcatggcggcgctggacaacggaattatttccgctgctctgacgacgattaacagctcttttgatgtttctccttcatggggatcatggggagtgaccctttacacattgggactcagtgtcagtgtgccgattgtcggcaagctgtcggaccgatacgggcggaaaaaactgtttatgatggaagtcggcctgttcggactcggctctttgcttgtcgcactcagtcagagcttcccgatgtttttggcggcacggctcattcaggcgcttggcggcggcggaatttttataatcgggagttcgcatgtgctggccgtgcttccgaaggagaaacaggggaaagctctcgggcttttaggggcgatgaacggtatggcggccgtcctcggaccgaatatcgggagctttttgcttgatgtaaccggatcgtggcattggctgttcttgattaacctgccgattgccgccgctttggttgtgtgcggcggtttgtttatcgctgaaacgaaagagcctgaggcgaaacggcttgatctcgccggcacaatgctgctgtctcttgcgatcttatcttgtatgatcggtatcacgaatctcgatgggacgaagctgtcagaaagcataatggacgtaaaggtgtatgggtatcttttgggagcggcacttctctttctggtgctgcttaaggtcgaaaagcgggttgaataccgcgggggcgatccgattctcgcctactcgctgctgcaaaataaagtgtttcaatggacgcttgtcatcggatttttatcgggagggctgctcgctgcggtcatttttattccttcttatgcggagcaatatttacacgtatcggcggagaaagcgggttattggatgacgccgcttgcgttggcgtcaggcatcggagcgtggctcggcggggcggtcacggataaaaaaggaccggtcttctccgcggttgtatcaggcgccatcgcctttgcgggcttcagcctgtttccgttatgggtgacggataaatgggaatttgtcacggcgagtgtcattgcggggatcggtttcggatttctgctcggggctccgctgaatgtgcttgtatcagaaacggcgggccaaaacaaaggaacagcgctcggcacgctgtcactcgtaagacaggtcgggctgacgctcgctccggctttatatgccggcttcattacagcgggctttgaccggatcggagaggacattaaaaaccgtttaacgaaaagcggcattcccgctgatcaggcgcaaacgcccgatatcggcggcggactttcttcgttgcaggagcaggtaagccgaatccccgttcccgccgtcaaaaaagcggtttctgatgcgattgaagcgggcatttccagcggctaccaccatctttatacggcagccgccgtcatttcattatgcacgattgtgtctgcggctgttttggcgtttttccggaagccggcatcctctaagacagatgccagcccatccgccgggaaagctcagtaatatgggcgatgtgatgttcagagtgccagacatatagcccgagcgcctgttccagcgtaaccgtctctttagatacaggatggaagtatgtccgtttgaattgggcttccgtcatggagcgcaaaagagcggcccatcttctgtgcaggatcgttaacagctcaagcgcatccccgcaagcggcggttttggaatcatgaagagcggcccagcctttttcatcataggacggatttccggttcattctccgttaagctcaatttaaaccgggtatagccgttcatgtggctgtccgccagatggtgaaccacttggcggacagtccatcccccttcgcggtacggcgtatcaagctgactggccgacatcgctctgacagcttggttcagtttagccggagcgtgttccagcgcattgatccattcttgtttctgtccggccgaaatcgattcagccggctgatactctccaatcggatggctgagggtttgtttttccatttttgtctctctcccgctgctcgtattatgaaagtatgatggtgatgtcgcagccttccgctttcgcttcacgaaagacctcaagcacactctcggcgccattttctgtaagctgcttgctttgttcaaactgtctccattctaaaacaagggggtactccacccatccggtcagacagtcccataaagcgtcaaggttttcaccgtagtactcaggaagggcaagttcctttttcaatgtctggtgcaggtcgctcatacttctgatttgctccccgttaataactgctttattcatgcgcggctcctttctcatgattctattctatcagtttaccattttcctcttcagaagtgaccggagtctgccgcggttccagctggacgatgccttgcccgccgtcaacggccaccctgtcccccgttttcagttttgacgttgcatttccgcacccgacaacggcaggaatccccagttcccgggcgacgatcgccgcgtgggacaaaggggcgccgacgtccgttatgatggcagccgctcttggaaaaagcggggtccagcctacattggttgtcgacgtcactaaaatttcccccgccgcaaaagaatcaccgtcttccggagcatcaaggacacggacaatgccctccactctcccggccgctcccgcgaaaccttttaaagtatgcgcatcatccgtttccgcaggcataaaagcatcgtaataatccgctcttctgtcaggatcctcagcccatttaaacggattgaatcttccgttaataacggatggaaacggcggcagttttttataggtttcatagttttgctttctcgcttgaatcgacgcaaccgccggctctttccccgcgagcagatcggttatttcatgcagatacaggaagaaaatatcgtccttcatgccggtcatttccgccgctctgagcgcgaatgctctggctgtccggtacactctgacaaattcggatctggttgtttctctaatattcgcgtattctgacgctttttccattttggctttgagccatttgaccttatgaggaaactttttttcaaatcttcggaaggcctgttcatgcgcccgctgctgtttcaaaagcagttgttcggcatcaatacccgactccttgtgttctttgatctgcttcgtcagccaatcccggttttctcccggatgcggtatggaaagttcgtattcatgcgggccacggtggccctggttcctgagatattcttcctcgctcatacggcctttcatgacttgatcaatgccgataatcggctccaggctggccagtccgccttttcccctcagattggaaagcaggagattcgcatcttctatgcctgcgagttttgttaattgagaggttaacgacgaagaggattgcgcagaatcacgcccgccggatattaacgcaaaccacgcgttgcataaatacggatagatctcatcgttccatatcgctaataatgcctgctccgtttcggcgcgtttcagcttttcctcaatattccggcaccactccggtgattcgtccaagtaggaggacatgttttttttcgcttgcttcattttcgacagatacggtttcagttttttcgggatgatcttcaataattcatactttgagaacggatataaaggtatcttcatttccgccgggatttctcccaatgtatcgctcatcatttttccaatttttccgcctttcggattcagaccgaaagcggcgagaacggaaagaggctggctcatattgttataggctctgccgcaaatattgccggaccagacataatagcccggaatgatgcccgactcttcatccagattccggaggagcgaccatgtcagcggcgtcatcacatcgggaatcgcttctcctatatttgtgtttgtccataaaaaatcaccgctgaaagaatcgttccattcataggtttccagatttccggcttgtaaggtcgtaatcgggcgggattgaagaatatacaatgtcccgcccgcggcggcccattcaatatcctgcggccctccaagatctttttccagctttttcgccagtttatagagctttgacgcatatttgcgaaattccccggggccgtcatattttttcttgggccgtgccagtttaaaagaataggcatcggcttccccggaaacgagctgctccccgagaccgtagacgtaattgcctgtcatctcccgcctgctccccgtaatcggatctgcggtaaacagcactccggatatctcagacggtatcatcagctggatgacgattgcgatttcatgctcatcttccattccctgaacggcgctgtacgcttttactctttctgactgtaccgaccggcggacttcatcaatcgccctggacatgtcttgatctgttctgacattcaacaccgtatcgaattctccggcaaaggaagcctgagcggaatcctcgctcagcgcggatgagcgtacggcaaacaacgcagatgcatggcggctgcggatggaattcacatattgatcaacagcctctctcgcctgatggcggagctgtccgtcctgaaaggctgacggcaaaatcacaaacccttcaggcacaggatacccgctttgatacattttagagagaatgcttccttttcctcccgcaaaggaataaagttcggccggaagttctccgaatgttttgacacagtcattcataatgtccccgctcctttttagtcgttcatccaagctcacagtttttctctttttcactttttttgaaagtatttcctataagtatacaatatatcggtcttcacaagggagaaaatcggtggcgttattttgtcataaatgcatccgtcaaaacagccgcaggcgggggctttgtatgcaggatgtacaactatccgtcctcgtgccggataaagcggacccgtatcaaaaaggcggccgaagcgccgcctttttttcagactgtgcggccttgatgcgccgccgtatttcttttggtctgcttcggctgatacactttcccgacaaacaggtatccgtatctgaaatggttgcacccccacgatacgaaaatgggacctagcgtgcagatcaaaaataaaagaaggatggcagccgctaaaggcattgaccgcaaatagccttccagaagatatccgctgattaaaaagtaggagtgcagcagatagattgaaaacgaatagttgctgatcatcatcacaatcgcgggcacttttttgagctttgaaaacagatgaaaacacagaaagatcatactgaccgcgtaaatcataatatccggacgcttagaggaaatggagccgccgctgatatatgaaacggccacaatcaatattgccgatacggccgcactgaagtaaaccgcataacggtactgattgatgagcgataaaaaacgcggatattcctttccgcaataaaatgccagacagaaataaaacacccagcccggaaacggaacccaaaagaacggaaaaatagaatcaagccccgatgatgccggcggatgaaagatggaaaagtaagccagatagacggcgttgatgataaacgaaacagacagcacccacacgggggatgtgttgttcagccagcggtgcagcagcatatggagaatgtaaaattgaaagatcacaagaatgaagtagccgatgaagtttcctaaaaacacattttctaaaaatttaccgatcactgaaacgaatccggctccttcttccgccacgcttttcattaaaatggcatccaccgcggcaataaacagaaacggcacgaaaatgactttgccccttttctttaaaaaacccgctggaacgcctttcgggtatgacctggcaagcagaaattccgaaataaagataaacgccggcgtgctgaacatcaagagggtccgaaacgcatcaaccgtatgggcggcactggctaaggactcttcctgaatcatcagcaccattgaaactgcgtgaagcagaacgacacttaaacaggacaggcagcgaatcacgaaaatttcttttatctgcatgcggccgctcctttttcacaagcgcgccggactttggcgtatgcttggcgcagccatttttcccgcagttcgggtgtgctcgttctgacgacagaaaaaaggttccgctcggctttttgaatgccgcaaaattgcagaatgctttttttcagcgtaatccagtccgagtttttccggaaccactttaagtaccagcccggggagtccgccgtataaaagacctgtgccgtctctgcccggagcagtccttttacgcggccgttttcatatgtgtaggcttctccggcgacaagcactctgtcaaaaaagcctttcataatcgccggaacgcctccccaccacagcgggtagatgaaaatgagatgatccgcttctttcatcagtttccggtatttcttcgtttcagcgtcccggttcatgtcagagcgctttttttcgccgccgtacttcagcacgggatcaaattgatcggcgtataagtcaatgaccgtatagctttggccgctgtcctttaaagccatggcgacgtattttacgagagccgcattgaaactgttctcatccgggtttgcatacacaatcaccgtcttcatatgtccctcccagtatttattaatttttacaatgattatatcatgatgtcatatgaatgaggcaaagacacgagaaaggctttttccagttctgctgccgtttcgataacccctttctgcatatttttgctgattttggcgccgcggattcaatgataagcatccggtgcttctgcgtttttgagcggccgtatggtatactagctgtcaaatgaatgggcttggaggacaacatgagaattttaaagtacgcgattttagggcttttgcgaaaaggcgaattgagcggatatgatatatcgagctattttaaggaagagctcggccagttttggagcgcaaagcacagccagatttatccggaattaaaaaaactgacggctgagggatttattacgtttcgcactgcgattcaaggaacgaagcttgagaaaaaaatgtacacgctgactgacaagggagagctggagcttgctgcctggctgacgaaaaaagacccgattccggaaacggtgaaggatgaatttatgctgaaggcttatttcatctcagctttgacgcaggaagaagcggatgagctattcaccgatcagctcgtaaagcggcaggagaaattgtccgatctggaaaacagttatcaagaactgatgacatcgtccgcggaggcggattcattttcttctcctgatttcggccattatctcgtgctgacaaaagcgcttgagcgggaacggaattatatttcctggcttgaagatattttggctctcatcaaaaaagcataaacaaaacggggcggctctgtatctgcaggccgcctgtttacgttctgaggaccgcattgataaacgaatcagccattaaaataagaaaaagcagactgaaataaacaatcgaataaaaaaacatccccttcgaccattgcgtgtcatccgccgcctgaaagcctttgacgctccggtacagccagatggccccgagcaggagagcggacgcggtataaaacgggctgacgtctatataaagaggaacgagcagcgaaaccgcagtcaaaacggcgatatagcgcagcatttttatttttgtgacgcgattgccttttatgatcggcaaaagcggaatgccggcggcacgatactcttcctttcgcctgattccgatcgcccagaaatgcggcggctgccacaaaaacataatcgcgtataacaaaatcgcgggcatatcaatgtacccggccagcgcgcaataaccgattaaaggcggagccgcccccggaaagctgccgacaaatgtgctccagacggattgtcttttaaaccaaagcgtataaacgacggcatacagcaaaaatgcaagcaggccaagaacggcggtcagtacattaagcgaagcaagcatgatgaatccgcatacgccgagacatgtgccgtacaggaccatgaccgtcggcggtattcttcccgtgacgctggcgcgggtgcgggttcgctccatctttgcgtccatgccgcggtcaaagaagttattaaaaacagtgcttgacgccatgactaacgccgtgccgatcatggcagccgccatggcggcaaatataccgggccctccgtccgtcctttccgactgaagccacgcgatccaaaatccgcctaatgcggcgagtgaatttgagatgataatccccggtttggcaagaatgataaagtccttgaacgtcatccggtttccgttatgcttcatagactgttccgtctgtgctgcatttgaattcatttgtggaggttctcctttttcggcttatcatatcaggaagaatcaggaagtacaatttattttgggcatttttcacacaattgtaaattgtatatgaaaagccgcatcttgtgaccggatgcggctcttccctttttctattcaaagtctgcccatacagctccctgatccgccgaacggacacccattttcaatccagcggatgccctgagttcgggccggcgatggcgggctccacgcgtcatgtttgcgcctcactgagatgttcgctctcttcagtcacacaaaagccgggtgtatattgcaaatcgacgttcttctttcccgagcctttagaaaaataaaaacccttgccggttagacggcaagggttgtttcttacagtgtaaatgcgatatccgcccctgatacagggtctttgacgaatacgccctcttctctttcttcgatctcaaagccggcatcggtcagcgcttttgtcacacgtgacagctctttttgatgcggcagcgtgatggtgtaataatccagcccgcttgcatttcccggtttcggcggcgcatgttttccggcccatatattcagaccgatgtgatggtgataccctcccgccgaaacaaacagagcggacatgcccgcgtaattgccgacaatgtcaaaaccgaggatatcggtgtaaaacgctttggcttcctgtaaatccgtcacatgaagatggatgtggccgataacggttccttccgggagacggcttttccgttcagctccggcttcttccaaaagcccgtccacatcgacgggcgccgtttgcatgacgtaattgccctctgcatcccggcgccacgtgctgcggggacgatcggcgtatatttcaatgccgttgccgtccggatcagacaagtaaagagcctcactgactgcgtgatccccctgcccgagcgcgatgccgttttcaatcagcctggccaatgcgatgccgagttctttccggtcaggcagaagtatcgcgaaatggtaaaggccggtgacagaccgctccgggagaacgacggcgctcggattttcttcaagcaccagcaggacgcgttttccgtctgctgacagttctgcagaacgatctgtctgcgagatgacttgaaggccgatgacattccgataaaagccgagcgagcgttccatatttttaatcgtcaatttgacataaccgattgctgtatcttgatgaatgccggtcatttgaacgccttctttcttatgctgaaaaagtttctcccttttttgatttgaaaaggagctgatccaatgaaagcagacggcttcctgaaagcgctaagtgaattgacgcaaccagtaagatgaaatcaaattccgatccgcccataaatggtgaggaaagcttcgccgtgaagatggcgccgactaatgtgacggcaaacagaacgccgataatgcgcgtcgccaaaccgaaaaagatcagtaccccgccgacaagctcaatcgtcgcgatgacgtagaccataaaggccggaagcccgatgctctggaaaaattgcgtagttccttccaacccttgaaacttggataaaccgtgaacaaaaaagataatacctgttacaacccttaaaagcagtgttcctgtttcgaatgatttattcataaaatcctccttgaaaattattatcacttactttatgtaagctagtatatatacataacttatttacgtcaagtaattttgttacatttaacgaaaataacttaaaagtactatttgtcttcgcaaaaaaaagacctccgcactctgtcggaggtctttttccctacctatgattcccggaactggctctcatataattcccggtaaaacccgttctggctgagaagttcggcatgggttcctttttcagccatttcgccgtctttcagcacaagaatctgatcggctttttgaatcgtgttcagcctgtgagcgatgatgacgcttgttctgcccgccattaaacggccgagcgcttcttgtattttcacttccgtcaccgtatcaatgttgctcgtcgcttcatccaaaatgagcagcaccggatccgccagcacatctctcgcgatggaaataagctgtttttgtccttggctgatgcccgcgccgttttgggtaaggacggtatcgtagcctttcgggagccgttcgatgaatccgtgggcattggcggcttttgcggctgcctccacctcttgatcagatgcatccagacggccgtaacggatattttccctgatggtgccctgaaagagaaaggaatcctgcaggacaaaccccatgttttttctcagactggacctcgtcagttttttgatgtccgttccgtcaatgaggatttttccgttattgggctcgtaaaaacgggcgatcaggctcgtaacggttgttttacccgctccggtcggtccgacgaaggcgattgactgtcctttcggaacgctgaaggacagatgttttaagatcgggctgtcttcctgatagccgaaggagacatctcggaattcaatctctcccgttttgatcggctggtgcgtcgcatgctcttcatcttcccgctcctctttttcatccagcacgtcaaacacccgctcagccccggcgatggccgataacatcgtattgaactggttcgccaaatcatttaaagggcgcgtgaactgccgcgagtattctgcgaatacgacaatggaaccgatcgaaatccaccccttcagcgcaaacagcccgccgaccgccgctataatcgtaaagcttaaattgtttaaagagttcatgactttcggaatgaatcccgaaattgtctgcgcccaaaagcctgatgattgtaacgccgcgtttttttctaaaaattgctccatgacgcggtcttccctcgaataggctttaatgaccttcgctcctgatatcgactcttcaataaaaccgttcagctcgccgaggtttttctgctgctgcttaaacaggagtcccgtccggttggtgatccatttaatgctcaaaagcatgatcggaataatcaaaagcgtgatcaatgttaaaagcgggctcatgaacagcatgacggcgattgtgccgacgaatgtaatgacgctcgacagcacttgaatgacggatgtatttaaagtggagctgacattttcgatatcattggtaacccggctcatcaaatcgccgaggcgctgtttatcaaaaaacggtatcggcagctcatgcagatgggtgaacagctcgctccgcattttaaacacggtgctttgcgagatattgatcatccaatagttttgaaaccataaggacaatgattgcacgaggtaaatcccaaacagtatgaacagtacacccgccaatccgtccgtcgtccgtccgacgataaaatgatcaattgctttcccgatgacgaacggtccgagcaggccgaatatggcgcttatgactaccatgatgatcacaagggttaaaagcccttttttctcggctacatacgaccagattctgcgcagcgtgccttttgtatcttttgctttcgcgcgttttctgccgccttcatttgatttgagcggtattttcggatatcggaaaggtttacgaatgtctttctccactgtcagctccctcctttccgaattgtgattcataaatctgccggtacagatgagactgtgccatcagctctttgtgcgtgccttttgccagcaattcgccgtcttcaagcaataagatggtgtcagccttcatcgcggtggttattttctgcgtaataatcagtgtcgtgcattcataggatctgatcgcttgtaaaagcttcgcttccgtttgaagatcgagcgcgctcgtactgtcatctaacagcaggagggacggctttctgataaaagcgcgcgcgatggaaatccgctgcttctgcccgcctgacaaattgacgccccgctgtcccagcaccgtgtcgtacccgtttgacagcttcataatcgtgtcatggatttgcgcgtctttggccgcttccattacttcatctagtgaagcttcctcccgtccccaggcgatattttcacggattgtgcccgaaaacagaagcacttcctgcggcacatagccgatttccctgcgcagcccgcaagcggagaattcaccgatcggtttgccgtctatgaaaatactgcctgaatcagccgtgtacaggcgcggaatcagctgaaaaagcgttgatttccctgaacctgtcgcgcccataatggcaaccgtttctttcgggctggctgaaaaggacacgtgatgcagcgcgtctttttccatgtccggatagcggaaggacacttcgcgaaactcaatcccgcctgcaagcgcccgcgccgggtcgtgccccgttccctcgccgccttctgtttccagcacctcgccgattctttccccggaagccttcgcccgggaaaataccataatgagaaatggcaggacggacagcgcgcctgtaatccgcgtcgcatagttaatgacggaaacgacatcgccgacctgcgctccgccctgagcaatgcttttggcgccgaaccataagataaacaaaatgcagctgttcatcagcagcattaaaatcggcatcgccgcttccacgagacgaaaagcggaaaccgttttttccatcagcttcgtattcgatttcaaaaaacgtttcacttcgtggtttgcacggaggagcgctttaatcagtttgatcgccgtcaggttttcctgcatgatcgtgttgacctgatcaagccgcttttgcacggaccgaaacagcgcgccgcctcttttcagcacccacagcaaaaacaaaagcaaaaccggcaccgtgatcagcagaaaaaaaccgagtttcgcattgacggtcagcgagagaataatgccccccgcaatcattaacggcgccctgagcataaaccggagactcatgaaaagcatattctggacctgcgtcacatcgtttgtcagcctggtgataaacgacgtagatgagaattgcgcaaacgtcgaataagagaaggattgaattttttgaaaaagcccttttcgcgtatcatacgcatagctctggctgatgtgggcggagtagaatgaatttaaaattcccgatgcgaatgaaacagcggtcagtccgatcatcaccccgccccacagccaaaccgtaccgagatcctgctttaaaattccttcgtcaatgattttcccgatcagcaggggctgtatcagctctaccgcaagctcgatgagcatgaaaaacagagcgattcccgccaaaagggaatacggttttacatatgataaagcctttgacatgtgtaagcctccaaatcctttgttcaatattattattttatgcctttccggcaaatgaataaagaaatttggtgtgccgttttttcaataatctgcgaaaaagataaaaccttcccggggaggggaaggttttgaccttattgatccaattgctgttcaatgcgctcccgcatttgcggaacgcctaatccgacaatgacctgaagcgccctgccttttctgacgacgccgtgggctcccagctctctgaaatcggcgtcacttttgacctttgattcatcagcgacagtgacgcggagacgggtggcgcaattggtgacctccgtaatattgtcctttccgcccaacgcttcaatatacaaagcggctgtatcccgctgtgtttcgtctgccgcagccgtttcttttgaagcctgcttccgttctctgtactcctttttcgaatagagctttgtttcctgcccttcctctttttctctgcccggtgtggcgatgttgaatttgagaatgaggaaacggaagacgaaaaagtaaacagcggtaaaacacagcccgatgatgatctggtatacatacgtcaaaccgtggcttgacgccagcgggatccagttcaaggtcgcagcttcgatcaaaccgcctcccatatttccgacgacgcctgccatatacatgacggttgccatggaagcggcaagcaaagcatgaaccgcaaataaaaacggcgagataaaaaggaatgtaaattcaatcggctctgtaatccccgctacaatggacgtcaaggtgaccgggatcaaaaggccggcgacgatttttttcttttcctttgaagccgtggcgtaaaaagcgagcgcgattcccggaatgccgaagattttcgagttgccgtgaagcgcgaagcccccctgcgggaacaattctttcagcggtttgacgctttgagagtattccccgagatgctgggcccaataggtgacgataccgccttcagccacagccggaccgtaaataaacggcgagtaaataaaatgatgcaggccggtcggaattaaaatccgctccaggaatgtgtaaatccacacgccgatcgccccggaagaaacgagaaaactttgcagcgatccgattccggactgaaccatcggccatacgtatgccaccgcaagtgaaatcggtatcataatgaagaaagaaatgataacgatgtaggaagatccttgaaaaatccccagaaaatccggcagttttttatcaaagtaacgattgtgcaaatacacgacaatagatgaaataaagatggcgccgataatattcgtatcaagcgttttgatgccggcgatcatcgtcagcccgctcgttccgccggcttcctgagtcatatcgacatgaaaagccccgccccaaaccgtcagaatcgcattgataaagtaattgaatgtcagataaactgtaagcgcttccaaacaagcccgcgcctgcgcttttttcgctaaggcgacagggatgccgatcgcaaacaggagcggcatttgattaaagacggtccagccgccctgttcaatgacgtaccagcattgataccaaaacccgtcaggatcagccagcggccccatcagcgttttatttttaaacagcgtgctcagaccgacaataataccggaaaatgcaaataataaaacaggcacaaacatcgcgctgccgaagcgctggactttttgcatcatttcacgtgacctcccgctatttatcaaaattttcgagctctttataatcaacatatgcacggaataacgcttcgcccaccagaaaaaacggggcaaatgcgacgatttccgttttatcgcttaacgtcaccggcttgctggtcgcataaagattatacggcgtcgtttgcgccagtacgttgtttttcagattggtgattgaaataaacggaactccctttgcggacagggtccttacctgcggaattaattcgggtgtttcgcctgataaagaaataatgatgaatacgtcatcaaccttaaaatcatcacacatgatattaaactctgtgatgtcctgaattaaaatcagatacttccgccgggatacaaacatccgctgcagctcacgggcgcacaccctctgagccgtccccgatccgtaaacgaaaatccgttttgcttcatctatcagccggcacatctccgtcatatcttttgacttcacgtattttacattggcttcaatatcatccagcagcttttcaaacgtcatattctcgccctcttcaggctgatcctcccatttcagaaaaacacggaattcactatagccgctgaagcccagtttttgggcgagccgcaggatggaagaccgagagacattacaggctttcgccatgtcattgataccgagatggtagcacgtatgtttatgattcaatatatattttaaaatataaaaatcgttgtcatttaatttcgcgtaatgctgattaaccagttcttcaagactcatcccaaaaatccccccgttttctttctattatatagaataacagataaagaaaacggggaagattgtcatcaggaaataggagacgggcttacatcaagctcaggccagtagtccttattagcctccatcagatcttcaagaatcagtcttgccacacgggcattcggcactgtttttgacaggatcagcgcctgccacagcttttgaaatgaccgctcttcccacgcttcagccgtcagtttttcgacagacacctgctgttccatcaggcctttttgaaattgcggtatgttcccgactgagagcggttccggtccgtttgaacctacgagacaaggaatctcaaccatggctgacggatcaaagtttgcgatcgcaccgttattttcaacgattaacagcattctctccccggtgttataagcgatggcccgggcaagatcgacgatataggaagcatgatcatcaattttaatttcactgttctccgatgattgttcgcgcgtaatcatatcgcattggctgaaaatgaaagcttcgcgcccttccatgacttcgttggctctcgtatggttcggatttgattttttcaccatatcatccgggaataagtaatattgcagatatgtgttcggaagcgtatccggatcagccgcctgtacgtcgcgcgcttttttgaaggtgtcattccagcttgcttcagtctgttcggcctccgtcttcggaacgtagccgtattcacggacatgctctttcagcttcggcattaaatcattgccttctcgatccgtgatggacgtccaccagccaaagtggttcaagccgtagtaacggacgttcatttcttttcgtgaagataatccgaggatgttcgccatgcgatcctcaattccgaccggcatgtcgcagatgttcaatatttttgaattcggtctgaggcgccgtgtagcttcggccacaatcgccgccggattggagtaattcagcatccatgcgtcaggcgagtacgtttccatataatcaagaatctccagaacaccgccgatagagcgcatgccgtatgcgattccgcccggcccgcatgtttcctggccgaccacgccgtacttcagcggaatttgttcatcgagcgcgcgcatcgcatattttccgacgcggatatgcgccatgacgaagtcaacatccgtaaaagccgtctctgggtcatcagtcgccaaaaattcaatgtccggcgctttttcttttatgaatacctcacacgcacccgcaatccgctcctgcctttctttatcattgtcataaagtttcagctttctgatcggaaactcttccaggtgattcaaaagcattaatacaattccgggggtaaatgtgctgccgccgcctgcaataacgattgagaatgatttgtctgtcatgtgaagccctcctctgataacgtttacattttatttatatcatgagaaggtccgatctgtaccgggtttgaaggagttagatcatttgatcatttttagttatttttctcaaaaagcgggaaagttcccacaggtacgaaaaaggcctgctgtcatcagcagaccccttctcaaaaatgctcttgtaaatcagaaagcagcacttcctgctcaaattgtggatttccgatcggaaaaatcctggctgtttccttgtcttcgttgacatgctgaatataaatcgggactccttcatacgtcacatacgccatggcggcggattccgaaatgtctttcgcacgctgtgtattcacgtctcaaacctcctttagtcctcacacataacgtgtccggcacccaagagaagtatgcttgtttcttacaattgtccggcggtgagtttgaattttttgaggcgtttgtaaaacgtgctccgcgggattccggccattttagcagccagcgtgacattccccttcgctgattcaagcgcgtttacgatgatgtttttctgaatgtgctcccggatggagacagaggacgcttcttcctgttcataagactcggccgcttctttaagacctgacgcttcaagcagggctgcgatggggcgccctgacagccgtccgtccgggaacatgacggaaagacgttcaaatacattaaacaattccctgatgttccccggccatttccggctctttaatacgtctaaaaagtcaacaggaagctccccccgccagccgcgatttcgctgaaattcaaggaagagtccgggaatgtcttcggtgcgttctcttaatggagggaggtggatcggacagacgtgaagccggtaaaataaatcttctctcagctttttgcattcgacaagctgtctcagatcagtgtgggtggcagtgatgattctgatgtcaacgggaatctcttttgtcccgccgaccggggtgactttccgctcctgcagcacccgtaacagagccacctgcatggagtgtgatatttctccgatttcatcgaggaaaagcgtgcctttatcggctttttgcaaagcgccgctatgtcctttccgtttggccccggtgaaggcgccttccgagtagccgaacagttcgctttcaatcagcttttcggggaccgctccgcagttgacagcgataaacgggccgtttttcctggagctgttgttatgaatcgcccgggcggcaacctcctttcccgtcccggtttctcccgtaagacaaacggttgcgtccgttcgggcgacaagctccagctgctcaagcatatgtcgggatgacgggcttttgcctgccgcaccatgaaatataaacgacggcttttcttcccgtttggataagtaaacgcatgtgaagccgttctcctcccgcttcgtccgcttgatatgatagccctgttcctcaagctcgcgcagcatatgtccggtaaaatgctgaacgggacggcttgcggcgataacccggctcatttcattgcaaagcacgatcggatcatgagaccgggtaagcccggcgaatttgctgatcatgtcaagttctgtcattttgatctttagggcaagctcccgttccgccgtataagcgatggaggaggcaattccgagcataaaaggctgagcgcgggcggcggggcaggaaatatcaatgacacccgccagccgcccgtcttcataacggatgggcgcggcggaacagctccattgatgagaagcgagcgaataatgttcagagccgtgtatcatgaccggttcatttgtataaagagccgtcccgatcgcattcgtgccgacggccgtttccgtccagcgggcgccttttaagaaattgatgcggttcgcttcatgaatggtgcgcgggtggccgtcaactgaatggacaacgccgtctgaatcaatcaggagaaccatcatttccatttcccgcatcgctgttttcattctttctgcgtgcggcattgaggccgctaaaaataacgcatgcttttcggcctgcctttctaaatgatctgccggcattacattcggtcccttttctagataagggttgacgtcggcttttttgcagcggtgccatgaggcggccacccgcttctgaatacgggattcatcgagcacgccttctttcacaaagcgcttccaggttttaaaatcattccgaatgacattcattgtattcgctcccccctgttcagaccatcttttcatatattgtaggggaaaagtaaagcgctttcaacgaaaaataccccttctcatctgagaaagggtattccggttatacggaatgcaccgcaagtccggtgacattcagcagggcttcctgaagcgtttctgacagagtcggatgcgccgcgataaagtgctccgacatatccgccgtcatttcaccgttcatcatcatgaccgcctgaccgatcaattccgtcacgtccggtccgatcattgacaccccgacgatttctccgaattccggctcggcaatgattttcattttgccgccgtgctgatgcttaattaacgcttttccgttagcagaaaatgagcattctccgattttcacatctccgtatgtctctctcgcctgtgtttccgtcagcccgacagctgccatttccggcgatgtataaatacagcggggcaccgcccgcatattgactttgctatcctttcccgaggcatgcgcggcggctgtgattccttcatgaatggcggcatgcgcgagctgcattcctccggccgcgtcgccgcacgcatatatatgaggcacattggtctgcatatggtcattgacttcaatcccgcgcggagaataccggatgccggcttgatccaaattcagcccttgcaaacgcggttttctgccgattgcaaccaaaatgtgatcagcctgagcttcaatttcttttccgtcttttgtccacacggcggttttcctttctttgtcaatccgctgaagggcggcttttgtctgaatatcagccccgctgtctcttaaagagtcttcgaaaacggcggcgatttccctgtcttctgccgggagcagccggtcagccgattcaatcaccgtcactttcgttttaaaccggctgaataaagaggcaaattcgcagccgatcacacctcccccgacaatgagcagagacgaagggattttctgtaaagaaagcgcatctttgctgtcgattacccaatcgccgtcaaatggggcaaacggcagctccgccggttcagatccggatgcaatcaatatccggtccgcttccagaatgtcttttgcgcctccttcttcttcaacaagcaatgtctgctctgtgagaaatgaggctgtcccgctgatgactttaatctgatttgctttcattaagtattgaattccctgcacgagctggctgacgatttgccgtttgcgcccctgcatgcggttccaattgagtgtaatgttttgcggcagttcgatgccgaatgtatttgcatgcctgattttatcgagcacattcgcactttccaaaagcgactttgtcgggatgcacccctcattgagacaagtgcctccgagcggccctttgtcgatcagaacgacttctgctcctctccgcgcggcagtcacggcagctgcatatccggccggcccgccgccgataatggctagtttcattttttcacctctctctataaaatcaaaccggcaggctcttcaagcagcgctttgaccgttttcaggaagtccgcagccggggcgccgtcacatactctgtgatcaaaggtaagactcagcggcagcatgatgcttttgacaagctcatctcctttaaacgccggcgtttcatagcttgcgcccactccgagaataccggcttcaggcggattaagaatcggggtgaaatgctcaattccgtaacccccgagatttgtaatagaaaatgtcgaaccgtggagatcatctccggaagcattgccttcccgcgcccggcgtgccgatgtgctgatgtgatccgcaagctcaaggaatgaaagcttttccgcatcccggatcaccggcacgacgagaccgttttcaagagaaaccgccatcccgaggtggacatatggataggtgatgatccgctcctcttgataagagctgttcagctcaggatgctgtttcagcgcaagcaccgcggcccgggatatgaaatgtgtgaccgtcagtttaacaccgctccgctttttcgcgctgtcggcgagctgctgctgccattttacaagctccgtaatgtccgctttcatcgtcagcgtcagctgggcgctgttttgcaggcttttgtgcattcggtctgcaatcacttttctcatcgctgaagccggttttccctccggctgtgctgtctgaaccgaagactgcggttcagcttctgtcttcatcgccttgatgacgtcagcttttacgattctgcctccgggccccgtcccgttcagcgtatcgactttcaacccggctttctccgccatttttctggcaacgggagatattttcacgcggtgtttgcgcttttgcccggcttttggagcgggaatatgttcaggttcagcttgcggtttccctgctttttcaggagccggcgcctccttctcccgcacttcttcgccgttttccccgatataacagatgggcgttcccggcgggactccttctccctctttgactttaatgtgaagaagcgtgccgctttcaggcgcttctatttccatttctattttttccgagttgatgctggcgatgctttctcccttttctaccgggtcgccgacttttttattccagacggatacttcacctttcttcatcgccattcccagcttcggcattactacttttacagccattctgtatccctcctttaattcattgccggctcgccaagcaattcaagcgtgacgctgacaatttggtctggtgtcggcaaatattgatcttcaagcaccggcgaaaacggcaccggtgtatgcggcgctgtaatccgcttaatcggtgcatcaagcaaatcaaagcccttatcggcgacaatcgcagcaatatccgtggcgatgctgcagcgcggattggcttcgtcaatgatgatcagccggtttgttttttctaacgatgtgaaaatcgcttcctcatctagaggagacagactccgggggtcaagcacctcggcgtcgatgcctttctcagaaagctgtgcagccgcttcaagcgcggtattaacctgcttgccgaccgcaaacagcgtgatgtcgctgccttcgcgtttgatatccgcttttccgagcggaattgtataataatcttccggcacctcgcccttcatgctgtaggacgttttgtcttcaaaaaagaataccggatcattgtcttctattgccgccagcagcaaacctttggcgtcatacggattggacggcacaaccgtcttcagccccgggatgctggtgaacaggccatacagcgcctgcgaatgctgagcggctgcccggaacccggctccgtatgtggtgcggacggtgatcggcacttgcgctttaccgccgaacatatagcggaatttcgccccttggttaatcacttggtcaaagcacgttccgataaaatcattaaacatcagctcggcaatcggtctcagccccgtggatgccgcagccatggccgcacccatatagcccgcctcagaaatcggtgtatccagcactcggctgcgcccgaattcctgtacgagaccctttgtgaccccgagtaccccgccccatgcctcatcatcttgcaaatgatcgaccgccgctcccccggcgacatcctcaccgattacaagcacattgtcgtctcttctcatcgcaagcttcattgcttcattgatcgcgtccgacatgcttatgactctcgccatctcacattccccctttttcatatgacacgtagacgtctgtcaacagctcagactctttcggataaggactcttttcgctgaacgagacggctttttcaatcgattcgctgactcgctgttcaatgtctgacaatttatttgcatctgtttcttttagaagatagtttttaaagccttggatagcatccttttcttcaagatgctcagtcttttcatcctttgttttataagtttgggcatcgccttcgaaatggccgtagtttctgtaagtcatacattcaatcaaagacgggcctccgccgtttcttgctctttctatcgcttccccggctgcctgataaaccgctaaaatatcttttccgtccaccgtgacccccggcatgttgtaggcagccgcccgatcggcgattgaatcacaggctgacgcgtactcaaatgtcgtggcttcgccgtagccgttgttttcggcgatgaacacgacaggaaggttccatactgccgctaagttcagcccttcatggaaggtgccttggttattggctccgtccccgaaaaagcaaacgcttacatttttagtttgtttatatttagccgtgagcgctgatccgcatgcgagcgtaaatccgcccccgacgattccatttgcgcctaacatgcctttatcaagatccgcaatgtgcatagaaccgcctttgcctttacacagtccggtcgcttttccgaatatttccgccatcatgccgtccagatcacagcctttggcgatacaatggccatgtcccctgtgtgtgcttgtaatgctgtcgccatcatctaaatgagcgcacacccccgcagctaccgcttcttcaccggcatacaaatggacgaatccgggaagcactccttgcgcgaaaagttcatgcactttgtcttcaaagcccctgatttccagcatcttttggtacatccacagcgctttttcctcagttaatgacaagccttctcgttttaacaattccattttgtgcgcctccttctatttagggttcacacttataaatgcaagaagcatgccagcctttgaagcccgtaaaatgaatgtttttattttttcaatggagacagtttgagacaggtgtctcattttgtctcgatccgttccctttgtctcgttttatggcatacaaaaaagaccgggcatcaccctgtctttgacaatgatcgacgtatttatttcctcggaaatcttttattgcttcattcttccgcatacagtctatcacggcgtttgagtggttacactctttttttcatatccacgcgctgcagttcatccttttcttcaacagcccgattcagtgcttgaagcatgtaaccaatgcctttatacgatgacagaggccaggtgatatgctgatgctctccgatgacggcgtttagaatgcttcggtattttttcccgccaagcatgacaagctcttcgacgtcggaaaagcctttttcataaaattgacggcgcagctcgtccgctgccatgatctccgggtgaccggttccaaaagtgacatcgtaatttccgggaacagtatcatccggacgaagaaatccgtgcttcgccgacaaaatcacccactcatcgaaaaatgctttcgcatatcgctcgcatgcctgatgaaacgggctgagataagcgtcttccgcccttaccggccctgtatctgaatggacatcccaaatttttttcttgccgcaggggatgatgcacagtcgtttcatttttctctcccctttatgatgtatctcctatcaatgtaccattattcgtttatttctgcatgacgaaaccggccatggatctgtctgggtaaaagctgcacacaaaaaggcccggaattcaaaccgaaatccgggccggatgatgagttgtttatgtcactcttgctccatcccatcaagatactttctctcaaagtcatcgagcaatgcacgcacttcatctgttgactttgtattcatgcattgatttcttaattcacttgctccccggaacccgcggagatatatcttgaaaaagcgggggagcggtttatatgctctggcttctgcttttgaatattcatcatgaagatccagatgcaatctcaaaagatcaagcaattccttactgctatgctctctcggctccttttcaaaggcgaacggattagtaaaaatgcctcgtccaatcataatcccgtcaacaccgtattgttcagcaagtttcaagccggtttcacggtcaggaatatccccattgatcgtcaaaagggtatccggcgcaatctcgtcacgaagtttcttgatttccgggatcaactcccaatgcgcatctactttactcatttccgctcttgtacgcagatgaatggaaagattcgcaatgtcttgtttcagtatgtgtgtcagccagccgcgccattcgtcaacatccgtgtagccaagtctcgtcttcacacttaccggcagacctcctgctttcgccgcctgtattaattcggctgcaacttcaggacggcaaatcaggccgcttccctttccattccccgccacattaggtacaggacagcccatattgatatccaggcccttaaaccctaattccgccattccaatactcatttggcgaaagttttcaggcttatctccccatatgtgggcaaccatcggctgttcatcctccgtgaaagtcaaacggccgcgcacactatccttcccatccgggtgacaatagctttctgagtttgtaaactctgtgaaaaacacatcaggtctgcctgcttcactcacaacatggcgaaaaacgacatccgtcacatcttccattggtgccagtacaaaaaatggccgcggtaattcacgccagaaattatctgtcataacaaatccaaatcctttcatgatgggatacagtgaaacctttatcccaaaattaaaaactgaccatgcttcttttacacttatagcatgtgtcagcacttcttatcaaacgatagtaaattttgaacatttcactttttacacgttaaaagtaaaaaagcaaactggagtagaacacattaattgagctaacgtaatagactaccgctatagtcaaccccatatcgtttatttctgatcaactcagtcaactccttcacctttaaaagggtttgagagagaaaaagtgtgatgattatctacacctaatttttatttatattgtggtttattaagattagcgctgaccttcatctttcttagcggccttacttttgctctttttggataaaaaggattccaacctaaatagaatatcatatgagttctccctattaccataaaacaaatttcaagaaataagttgattaagcaaatggggctggggggtatatctgagtactgaaaagaatgtaaaaagaaaaagccttaacttgccgcttgtgaatcacatggagtaaagaggatggcatgggaaaataaactcgaacttaacagaattcaagaacttcaatctggatcttttcggatttactcatggtctagaaataatcaacgccgcaagtggcttggctctatacagtatatgtactaagggttgatcggcttttaaaccccgtatgttaatatctttatacaatcacctatatatatttgtataaggttacgcttcggtaatcctgatccaaaaccaataaaatagactgctgactaagtgccgcagtcttcattcataagattaattagaaagtgttcatgttctttcatcattaaataaggcatcagaagttattgctttcatttcggatattctttgttatacctttaatgatttgtataacagtgaaaacccccaagaaaacagtgacaatattaaaccatggattatcatagaatgaaagatatgtttgaaagaaatccagttcagctatatttgctgggaatccattcatttctctataattaggaccccatcccgttaattctacaaagttaaaataaagctgtgatactaaaaatgccaacaacgtgtgaaaccaacttcttttatatactttacccatttctttatccatttccttttctgcaatactttttagcctagtgtcaatctaacatcattatatgatgaagcatgattgtcgcaataattacttattaaggatataaccatcgcaggtattactgtaatagttgttatcacttgcgtttccgccttatatttattcctttttttagaacaagaggaatagttggggtccttttcctgtttaggctttcatattatatataacgaccaaacatgcttttttagtgtatttgatcttttatcgacagttgttgatatgccaactgccgctgtgatttagtgaaagttagcacccttgccttttacagcttctacttcagaaccttcgttcagttgttgaaatctcaatatctctcgttcggtttcacctcctttttatcatttattaaagacctacttactttggcatgataaatactttacagttgaataatgttacaacttcatctcaaaccaatgatatcaaattattttacattatcccattaatgtcacaataaaccacagcgtcattatacaaacgaggtcaaaattggctgttttctcctcgcttttccacacgttttttcaactcttttcatcagtttaaattaaagatctccgagaaaagaaggaagataaacagccagggcaaaggctgcgcataaaaaaaaccggaaatcggaaatgtttataccgaaatccaggtctgattacgaattgtttattttagttagacgatttcaacacaagcttcgccacagcttccacatgggccgtctgcggaaacatatcaacaggctgaatatattcgacgcgatagtctttcgacagcgcctgcaagtctttcgccagtgtggaaggattgcaggatacgtagacgaagcgtttcggttttacttttttgatggtatctaaaaatgttctgtcacagcccgttcgcggcgggtcgacgatgaccacgtcgggacggaagccttctttcgtccatttcgggagccagtgttcggctgttcccgtgacatatgccgcgtttttgatgccgtgttttttggcgtttttcttcgcatcatcaattgattctttaatgacgtccatgccgcggatctcttttgcgccgcttgaaacccacatgccgatcgtaccgacgccgcaatacgcgtctacgactttttcttttcctgtcagctgagccgcttgtttcacttcgtcatatagcttgaccgtctgctcagggttgagctggaagaaggcgcgggcgctcagttcaaatgacacgtcaccgagcacttcttgaatggcatgtcttcctgccagcgcttttgttttgtcaccgaaaatgacggatgtgcgcgcgccattgacgttttgaataatcgatttcacttccggcagccggttctgaatggctttgacgatctcgtctttattcggcagtgtctctttcgcggtgacaagcacgacctgcacttcgcctgtttcaaaaccgactctcgtcacgatggtgcggacatcgccttttttggtccgttcgttataaacggatacgttgtgtttttccaaaatacggcggacgatacccgttgttttgtttgtcgccggatgctggacaatgcattccttaatcgggacgattttatgggaatcaagtccgtataagccggcaatgatgctgccgctttgcgagcgtccgacttggaactggcttttgttccggtaattccaagggttgtccattccgatcgtatctttaatgttcatttcttcgacattgaatctcgtatgacgttccagagactgaatgacgatgtcgcgtttttcgcgaagctgctgggtgtatgccagatgctgaagctgacagccgccgcactggtcgtagaccgggcatggcggcgtgacgcggtgttcagacggcttgcggatgtttttgacgcgtgcttctgaaaatttcggctgcacatttgtcgcttcggcaacgacttcttccccgggcagagcgccgggaacgaagacaacttttttcttaaaatagccgacgccctctccgttaatgccgagacgtttgatggtcagcggaaatgtctgcccgattttcaattcggcaggcgcctttttttgatgttgattcacgtttttttctctccgtttctatataaagcctttctcctgggaaagcggctgatttgaaatatcacatcttttcagtataacatgcagccggcggttccttcatgtttttcactggaagtttccaaaaaatgatcaaagcggtttttcattcaatacttctccacaaatataaggacgcatagcttaaatacggcgcccattcgctgcttacctgaagcatcacgtctttcgacggtttatcctcaagggcgaagcggcgtttgatggcattttgcaggccgatatccgccaaaggaaacagattcgggcggccaaggccgaacatgaggacgttttggacggtccacgggccgatgcctctgatggtgatcagctttttcataatgtcttcatccgataaatgggtaagttccgccagattgagcgctccgtctgcaatcatgcgtgaaatgtcaatcgcatattccgcttttctcatgctgaactggagctcccgcaagtcctgataatcaagcgccgcgatcgttttcggctcgggatagcaccagacgccgtctttttgttcaccgaaggcatggacgaaccgttccgttaaggtaaatgcgaaagacaggttgagctgctggtggatgatgcatttcatgagacagttgtagacgtcatattccaagacgagcggggttcccgcatgctcctcaaaaagcgccgacagatttgtttttgagaaatgatcaagcacaggctgaagcggctgttcccattgaaaaatgtgtttgatccgttcaatcatctcctcgcggtccgtttctccgctgacgaggaagaccgggtctgcggcggtgccttccgcttgaaccgtagtgacggacagtttgccgtcccgtgttctgagcggcactttgattgatcttgcatgaagatcgaccgcattcagcggatcgagcgacagcctctcaaggactttatcaaaatgatacggcggcgtgaccgaaaccgtttccttccacatatgctccacccctttttgtccaagtatatcatgaagcgggcgggcggcaattcgtatacttttcttcataacgccgcatgatataatggcaggcggagggttgtttatgatacatataaccgcaatcacaacacataatgagatattagataatatccccctatcacgtacagaacaaccggacatcgcatggtactggatcgattttttcggcgctgagatgcatgaaaccgagctgctgcgggattattttcactttcatccgcttgcgatcgaggattgctttcagcatatgcagcggccgaaaatcgaccattatgacggctaccgtttttatgtgctccacgccttgaacccggacacactggaaatggaagaggtggacatctttcagtccgaccgtttcatcgtcagcttccatttgcacgaatcgcccggcgtctcaagggtgagagaacggtttttcgcttctccgggattagccaaaaaagggccggggcacatcacttatatgattatggatcagcttgtcgatgaatatttccccgtgctgtacaaaattgaagaccggctgaatgaaattgaagacagcagaacacataaatcttacggcactttaatgaatgaagtgtttgaattgcggactgatcttttgaacctgagacggacgatcattccgatgcgcgatttaatgtaccggattttgagccttgaccatgtaaaagaaagccgtgaaacgaaggcgtatttcagcgatatttatgaccatctgttaaaactggccgagctgatcgagtcaaaccgtgatatgacgtcagatttgcgggacagctatgtgacgctgaattcaaaccggatgaacgccattatgatgacattaaccatcgtctcgaccatttttatcccgctgacgttcatcgcgggggtttacggcatgaatttcgataacatgcctgagcttcattggaaatacgggtattttatcgttttgggcgtcatggccgttcttgtcgccgccatgctgttttggttcgcccgcaaaggctggtttaatattttcaagtaagaacggctgccggctgttcttttttttgagaaaacatgatagtctggaaaaaaacgtaaagaggtgtgcgccgttaccatcctttctcataaaatcatttcttctgtcctcctgcttttcagtgtcatgtccattgccccgctgtataacggccgtacggtgtctgattacatctttgagtcgctcggcttttcttcctggtctgaagacggagcccatatctccgtcattcccggggtcgtcctttactttgcggcgttaatctggtgtgccgccgcgttcaggcggacgcttccctcggcggggctgtttctgatctttctcagtatgggggccgcttccggtatcagtcctgccaccgaatatgccgctttttccttaaaacagttcgcgcccgaaaaagagtctgtcgaatatttgaagcaccgcagcgaatgcagtcatctgattgaacgaaaaagagcgggcatgagctgcacgctttatatcaatcattacggaaaaggggaacaaaccatttctgtcacgccggatttatcagaaaacataaaggacgtcacattcaaatcaaaaacattcactgtaaaaccccgttcaaaaacaatcatcaaaacccgatttaccggattttataaggggacagccgcctcagactccggatggtcttcagaaccggaactgaaagtggcaatcctgtacacagcagaataaccattttgcatgtataatggtggaaaacttttcattggagggactgtcaaatgaagatcgccatcgtcggactcggcaatatgggccgccccatcgccgaaaatatcatgaaagccggatacagcctgactgtatataaccggacgaaagaaaaagcggctgacctgctggataaaggggccgaatatgccgaaacgccccgccaggcagctgaacatgcggacattgtgctttcaatgctgtcagacgatgaagctgtaacaggcgtgacgttcggagcttgcggcattattgccgggttatctgaaaacggcattcatatttcaatgagcacgatcagtacggcgctgtcagaacagctttccgccgcacattcgggcagagggcagtcctttattgccgctcccgtcctcggccgccccgatgccgccgagaaggccgagcttcgcatcatcacagccggaccggcagaagcgaagaaaaaggccgaaccgctgtttaacatcctgagtcagcaagtatttgacacgggtgaagaaacaaaaacggcaaatgccgcgaaaatcagcatcaatttcttgctcgtttctatgctggaggcgttatctgaatcattcttaatgatggataagttcggtttagaacaaaaacaatttctagaaatcgccaacgcactctttggctctcccgtctatcaaaattacggcacgatcatggctgaggagaaatttgagccggccggcttcaaaatgtctttagggctcaaggataccaatctggcgctcgccgccgcagaacaggtttccgcaaaactccctcttgccgaactggcgaagagccattttgaaagcgggatcgcacaaggctgcggagatttggattgggcggcattgattaaatgtatcaaataacaaaacacctctccattaccaggagaggtgttttctacaggcgcggcagcttcatttctttctcaaacatcaggtcatcaatgcttttaaacgtgtagccttcttttttcaaatcggtaatggcatcgtccagagcttctgaattgtcctttgaaacggtgtgaagaaggtagatcgcgccgggatgcgcctgctttatcatgtgatcataggcgtattgttttcctttttgctcgttaaccttccagtcgacaaatgcgacggaccagaaaaccgtttggtagccgagacgcttcgtttctttgaggacatattcgctgaatacgccgcgcggcggacggagatacaggttgtcccgctttccggtaatgttgtacacagcttccgtgacggaatcgagttcgtcttgaatctgatcgcccgtttttgtcgtcagatcaggatgatgaaaagaatgattgccgatgatatggccttcctttgacatccgtttaatcaaatcaggctgctctttcacaaaatgacccgtgacaaaaaaagtgcccgtgacgtgatgtttttttaacacatcaagcactttcggggtgtacccattttcatatccgttatcaaacgttaaatagatggtcttttctttcgtattgcccaaataaaaggcatcatattttttgaccagattgtccagctgtctgccggcatccggcggctgatgattgacgctgcgtttaaatccccagtttatccgttcattcggcaccgcttctgcgctgttgatgcctcctgcaagtaaaacggccatgcagcaaattgaacaaaaccatttcatgaccagcactccttctgcatttttccttattttgcagtaggccctgcccttttatacagccgcattatggaaaaagaaaaaccccggcatccgccgggggttattcccaatcctttttaaagcgttcgtattttgcttccagatcatcaagcatgccgatgagccggtctatatcttcaacgtccgttgattcagggtctaatgaatcaatgacattcataaacatatcgagtctgttcttcaggtaatcgagctgctgatctttgctgtttactgcattccccatacttccactccattcattttttataatggtagcgtattttttggcgtttttcaatggttccgctacttgcgatcttggcagatcaggtctaaaattaacagttggcagacgttagtatgcccatttataaaggagttagatagtcatgacacaaaacacagcactgcgtccgattacaccggagtacgatccttgggaagcgtacatggatgtcgaccagtatggagatatgaaactgacgaacgttgaattcacaacgacgactttgtgcaatatgagatgcgagcactgcgccgtcgggtacacgctccagccgaaagacccggatgcgctgccgatcgaccttttattaaagcggcttgatgaaattcctctgttgcgctctatcagcattacgggcggcgaaccgatgctttcgctgaaatcggtaaaggaatacgtcgtcccgcttttgaaatatgcgcatgaacgcggcgtgcgcacacagatcaattcaaacctgacgcttgatatcgggcgctacgaacggattattccttatttggacgttcttcacatttcccacaattggggaacggtcgaggactttgccgacatcggatttgcgatgatggagaagaaaccgacatttgaacagcgggcgcgctattttgataaaatgattgaaaacagccgcacgctggtcgaagcaggcgtaatggtttcagcggaaacgatgctgaacaagcggacgctgccgcatattgaacatattcaccggcagattacggaagaaatgaaatgccagcggcacgaagtccatccgatgtatccgagtgatttcgccagcgcgcttgaatcactcagcctgaaggacatgagacaggccattcatcatctgctcgacattcgcgatgaagagacatggatgctgttcggcacgctcccgttttacgcatgcagccctgatgaagaagaccagaagctcctccgccgcctgcgggaagcgaaaaacgttacggtgcgaaacgaccctgacggccgctcccgcctgaatgtcaacatttttgacggaaatatcattgtcacggatttcggcgatacaccgccgctcggcaatattaaaacagacagccttcccgatgcatatgacaagtggagacagacgaagctgagcaaagagctgaactgccgctgcacaaacgtccggtgcctcggaccgaacgtccttgtcaaaaacagttattatcaggacacggatttttcattacgaaaagccagaggttaacagaagatggaaacgacaattacggatattttgaaaagcaaagtggttgagatcatcatcgtcgctctcgtgctttacgccggtgtttttctgatcaaccgctttgtccaggtgttatttaaacgcatagatttcttggaggaacggaaagggaaaacgattgaaagcctcgtccgatccatcacccagtatacggcgacgatcggttttatcttttacgtcatttcgttattcgttcatgatttcggccgaattttagccggggcgggtgttgccggtatcgtcatcggtttcggcgcccagtcgttaatcaaggacatattggccggtgtctttttgatatacgaacgccagcttcataaaggcgattacgtgacgattaacaatctgttcaacggcacagtcgaagaaatcgggctccgttccctccagatccgtgagtggaccggcaagctgcttaccatttcaaacggtgaggtcagacagcttcaaaactataatattgattttatgcggattaccgagtccgtcgtgatcagttataaagaagatcccgagcgggtatatgccgtcttagaaaaagcctgcgacatgctcaatgatgagcttcgcgattcactgaagcgggatgaatttctcaatgcgacggagccgtttcaagtgcatggaatcatgagcctgaacaaattgacgagaggcatagaatttaccgtcaaaggcatggttcaagataaagaatacttctcggcaagccttgcggtgagacgcgttcttgcccgggagctgtacaacaacaatgtgcaattgcttgaggaaatgtatcacacacaaaaaagctgattcccgaaccggaatcagctttttttatttatctcggctgcgctgtcatttgaaaaccgaatgtgacgtgatcctgcaccggaatccaagccccgattccttgcgaagtcacatttttgacgacaagtttccgcttgctgcctttcagcaccaaatacacttcaccgtatgttacttttcctttttcattaacggccggagcgtaggcgtgcaggtagccgagccgctgcggagaaattttgtaggtttgatcgcgttttgtgcctgcgccgataaccgtttcaaacgcgagcggcagttttgttttcttcatcgctttttgcatcatcatgctttttacgtcttctgcgttcggcaccttcgctgtgagcccgcctttaattttgtactgctgttcttgggcgtatgagataaccgcggtttgctgtccgccccggttatccgctctgttcgtattgatttttttatattcccagttggcgaccgtttcgttcgattgatagccgagcgcccatttcccgagaaatattgtcgcccggtagccgatggcaagcggtgaaccggaaaccgaggattcattcagcatttttatcagatgcggattttcgatgttgatctcggatgtatctaacaattcctttgccagtttgctcggctgaagcatcggctggtcctgtgaagcattcggatacgtattttcctttgaaatgcttacaacagagttgggaaccttaaacggtttctttgcaccggcagacggcattgcgaaaaaactaaaggataacagcagaatcagtgtggcatgaaacagctttctcatcatatcactctttctatagcattttcctttagtcttttcctccgcaatcgttgttatccgcattttttacaggttaaagcaggaaaaaaccgatcgccatgatgacataagcggcaaggagcgtagccccttcaaaccagttcgaatcgccgtcatttgaaatcatcgtcatcaaaaggacggatgatatcatcgccacaagctcgggcaatgtgaatacaagcggcatattgaccggaaaaaagatagaacagatcacaagaaccggggctacaaacatggcgatctgcaaagtcgaacctaccgcgatttcaacggcgacatccatcttgtctttgtacgccataataatcgccgacgcatgctctgcggcatttccgacaattgcgacgataatcaccccgataaacagctcgctccagccgaactgttcagccaccgcatgaaacgtatggacaaggttttcagatatgtaggcgacaataatagttgaaataaataagacggctgtcgctcttttccccgaccactctggctgctcctcttcttcctttgcctccggctgattcggctgataaacaccgcggtgagtgacgagcttgaaataaagagctgccacgtacaaaaggatcatgatgatgctgatgccgacactcaaatcaagcttgtttttttcccccatatctatggaaaacacttcgggaatgacaaaagctacgataatggcaaaaatcagcaggcctgaattatgccgggcatcatgaatattgaattcctgccgcttgtatttcaaaccgccgataaaaaatgacaatcccgcgacgagcaaaagattgccgagcaccgaaccggtcagtgaagcaagcacgatgcccgtcagcccttcttttaaggcgaaaatcgatataatcagctctaccgcattgccgaacgtggcattcagcagaccgccgatccgcggtcccgcgataatggcaagagattcagtcgctctccccatataacttgcaagcgcaataatcgtcaagcaataaataataaacaaaaccgctgacggccagtgcatcaggccgccgatgactgaaagcggcactcccgccgcagccgtaaagaaaaaaatccgattcatatctgcctggctccttttttcgaataagtctttttatatccttctcaaaaactccttcaattacacttcctcggcagcccgaattggcattttcaggttgccggacgcggcaaatccgtgtacgatcaagaaagatactgaagaaggagaaatacgcgatgtcacgactgtacttctttattttggttctgcttgtttccatctccggattttcccaaggcatgcttctgccggtgatctccgtcatttttgaaacgaacggagaatccgcagccataaacggacttcacgcaaccggcctttatatcggcgtgcttctggcgtcgccgtttatggaggccccgctgcgcaagctcggattcaaacctctgatggtcatgggcggatttcttgttatcatcagcttattcagttttatttggcttcaatccatatggttatggttttttcttcggctgcttatcggaatcggggatcatatgctgcatttttcaacccaaacgtgggtgacttccaagtcaacgccccgaaacagaggaagaaacatttcgctgtacggactgtccttcgggcttggattcgctgtcggcccgttcatggtccctcttgtgaaaacaagtccgtcccttccgtttatcgtatccggctgtatcagtctttgtgcctggctgtttgtgtttgccttacgtaacgagtacccggcgcaaggtccggatgaaacatccggggacaacagcgcaaaacggttttaccgcgcccttcttttcggctgggtcgcttttctcccggctttcgggtacggttttttagaaacggcgctgaacggaagctttcccgtgtacgcccttcgtttaggcatatccgtggatgccgtcgcgctgatattgcccgcttttgccatcggaagtattgtattccagttccctctcggtttattaagcgatcgattcgggagaaaacgtgtcctgctcgtcatcttattaacgggtgccctttgctttttgacggccggactgtttccgtcgccttctgtcatcggctgctgctttttcacggcggggatggcggtcggcagtatgttttccctcggcatcagctatatgagcgacctgctgccgtcccatctgctgccggcgggcaacctgctctgcggcatttccttcagcctcggaagcatgatcggcccggtggcgggcggctggtatatgcagcggtttgaaagcgccaacttgttttactttattacggtgattctggtctgtatttggcttgcgctcgtcttcgggaaaacaaagcacagccccgcttccgaatcccattcttttccggccacataaaaaagccgcctgatctgagccaggcggcttctttctagtggtatccgttctgcccgttggcgcttccgcttgttttattcttcgggccgttttttgagttttgtttattatggcttccgccttttttcgtatgcttggtcatagccgattccctccgtttttcagcttgaacgtcatccgttcctctatagcttgctcccgcggtacggattttcatcaggaagctttttacgtttatgtaaaagcgcgttgatttctcctcctaaaatcaacaaggttcccgtaaggtaaaaccagatcatcaggacgataattcccccgatgctcccgtatgtggcgctgtagttggcaaaggtgccgacgtaaaatgagaacagcatactgacgataatccagccggctgccgcgaatacagctcccggcaggacaaaacggagggaaagctttttattcggcgcgaatatgtaaagcgcggtaaacacgattaaaaggataagcggactgataccccagcggacaaccgaccacacctgcaaaaacaggtccgaggcgccgatgaaatccgcggccagcattccgatttctctgccgaacaccggcagaagcagtgcgattaaaatcgtaaccaccatcgcaatggttaaaaaaattgaggtcaggcgaatgatgataaatgagcggttttcctcgacttcgtaggcatggttaaatgctctgacaatcgcgttcataccattcgaagccgaccagatgacggcgataatcccgaatgacaaaagcccgccgctgcgcttgttcagcgtttgctccgttatggatttcaccatggacatggcgctgtcgggcgcgtattgatcgaccgccccgagcacgtcttctgccgatatgggaagataggcggtgagcgtcagcatgaaaatcattaacggaaacaatgacagcaggaaaaaatacgccagctccgccgatttactttgtccttcatgcagagaaaaccttgcaaacagctcctttataaaactcatgacatcccacctcaatgatcgtttttcgaaaaatgctccttcgtttcttttaacaggtcaatgacctgcggtgtcgtctgcttcagcttggtgatctgcccgtttaaaaaactcagatcttccgatacggtattggcgaagattttcacttgatccatttttgcggaagcctgctgcttcagggcttcaggatgttttcggtaaaatgccgcacgccgcctgcacgcgtccatgttccggaaacatgcctctctcgtcggcttatgtaataaggacagtgctccgccggcggcagcgccgatcagaatggcttttgccatgatgcgtgtctgcttcatcggtcaatcccccttataaatgatggtctttctttattgtctccagcaaatgacggcacccggactcgaccaaagcgtacacctcgctgaaatttccggtataatacggatcgggcacgtcggcaaggtctgactccggtacataatcaagcagccttgcaatacgcggcgccgcttttttataaccggccatgctgcgcagatgtccgatattttctgcatccatcgcaatgacgtaatcaaaatcggtcagatcagactcacccgacctgcctcgccgtgatgccgcttgcgctgatccctttctccttcaggatctcctttgtcccttcatgcggcggatttcccgcatgccaggcgccgattcccgctgaatcaatgttaatctgcccgttcagcccgtttttcttcaccatatcagaaaataccgcctctgccataggcgaccggcaaatatttcccagacagacaaacagcacatgtatcatatcgataacctccctattctttccccgcattttgaggatcaaaaaccttatcaacatcttagcaatttttctgcggctgtggaaataagcttttattctaaatgaattctgttagaataaaggggacgaaaacgatcatgaaaggatgcatgaatttgccgagccaacaaacagaaacgttaaataaaatgattgaagacatttcgcaaaagctcaacatgctcaatgtcggcgtcatcagagcggaagatttcagtgatgaaaaaatagaagatcttacataccttcatcaaatggtcatgaaaaaagcatcattcagcccgagtgaaatgcaggccattgccgaggagctcgcctctctcaggaaataaacccatgtcagacctgccgaaaaacggcgggtcttttttgatttaaaaaagtaaaaaataaaagttcatcggtttgacacatataaaaagaaggagtatagtaactgtgaacttggtagaacgatatactaaatgagcgggccgcttatctttttttgtttagtagaacgatatactcattgtgatatcagcgttattcaagtttgtctatgcaaccgttgtatcaaacagttttcaaagaaaggcagtggttcaataaaggggtatggtgctgtgcttttatcaattaaaaaaataatttaattctttattaaccgcattaggggatgtcatcatgaaaaacatatacaccaaaatggcagcgggtctttatattaactatttcctgctgggcatgatcaatattattatcgcatccaatatggaggcattatcaaaacagcttcatacttccgcagccggtgtcagctatttggtctccgccatcgggatcgggaagctgatttcgcttctgtttgccgggaagctttcggatacattcgggagacggccgtttatcgtgtcgggcgcctttctgtatctgattttcctaatcgggattccgctttcgacaaactatacggccgcgtttatcttcgccattttcgccgggatcgccaattcctttttggattccgggacatatccggcgcttattgaaggatttccgaaaaacgcaagctctgcaaccgtgttaatcaaagcgtttgtatcaatcggcgcgacggtgcttccgttttttatcgcgtttattgcggacaggcatttgttttacggctggacgtttttcgtaccgggcattattttcttcctgaacggcttttttctgttgaaagttccgtttccgaatcataagcaaaaagaagacggcggccggacggaagcctctccgtctgatgacgcgttcacatcacagccgtcgatatggcgcgaaggcgttgcgatcattctgttaggcttttcatcaacggcgctgtttatgctcgttcaagtatggcttcctaagttcgggcaatccgttttgggcatgcctgaggtgcaggccgtcaaattgttgagctattacagcatcggggcgcttgtgtccgtgttattgctggctgtgctgttaaacagagtgattcagccgattacggtaatggtgctgtaccctgtgatcgcggcaatcgcgctgcttgctctgattttcattcagcagccggccgtatcggtcatcagctcctttgtcatcggactttcaactgcgggcattctgcaattggcgatgacggttatggctgttttattccctaaaaataaaggtacaatcacatcttttgttaatatagcatcaagcttatcttttattgtcattccgcttgtaacgggagcgatatccaaagccgccggcctgacgcctgtttttctgcttgatatcggaattgcggccgtcagcgccctcctcgcattgtttatcggaatccgctttaagcaagtgatgaaagcctgactattttttaagggagaggatttatcatgcaatctatcacaatcagaaacacggtcatcggtgaagggcttccgaagatcattgtgccgctgatggcggccggagagaaagaactgctcgaagaaattgaagccgtcaacaggcttcgcccggatatcattgagtggcgggcggatgtatacgagcatgttgacagcctggacgccgtaaaaggcatgcttgaaaagctgcggaaagccgcaggagcaacaccgctgcttttcacattcagaacccataaagaaggcggaaataaagttattgatgaccgcttttacattgaattgcttaaaaccgccatcgaaacaaaacatattgaccttgcagacgttgagctgtttacgggagaagcggaagtcaaatcaattgtgaaaaccgctgaagacaacggcgtatatgtcgtcatgtccaatcatgattttcatcagacaccgaaaaaagaagaaatcatttcccggctccggaacatgcaggcgtacggcgcgcacattccgaaaatcgcggtgatgccgcaaagcactgaagatgttttcgtcttattggatgccactcacacgatgaaaacacaatacgcagaccggccgatcatcacgatgtcaatggcgggaacaggcctgatcagccggctggccggcgaagtcttcggctcagcgtgcacgttcggagcgggcaaagaagcatcagcgcccgggcagattcccgttgaggaattgcgcagcgtactcagcattttaaataaacatatgtaatcagcgttttttgccctcaaagcgggaggaaaaacaaatgaatggactaacggaggaatacatcatgaagaaagaattaggacggattaacggaaaaactcagcttatcggattattcgcgacaccgatcggacactctttatctccggcgatgcacaacctggcgtttaaaaaattaggattgaactacgcttacctcgcgtttgaagtcggcaatgaacagctggaagatgtggtaacgggaatgcgcgccttaaacgtcagaggcttcaatgtctcgatgccgaacaagatgaacattctcccttatctcgatgaactcgcggattcagcgaaatttaccggcgcggtaaatacagtcgttaatgaaaacggcagactgatcggacactccactgacggtatgggatacgtccgcaacttaaaagaacacggcatcgatatcacagggaaaaaaatgacgctggtcggttccggcggggccgccactccgatagcgattcaatccgcattggaaggcctcggagaaatctctattttcgcccgcaatgacgcgtttttcgaaaaagcggaagaaaatgtccgcatcatcaatgaagaaatgaagggatcttcttgtaaagcgaaagtcttcccgctcgaagatcaagatgcgctgcgtgctgaaatcgcttcaagcgatattttcacaaacggaacaggtgtcggcatgaaaccgcttgaaggcttgagtgttattgaagatacatccatgctccgtccggatttgattgtgacagacgtcgtttacaaccccgttacgtcgaaattgcttgaacaagctcaagcagccggctgcaagaccattaacggtctcggcatgatgctttggcagggcgccatggcgtttgaatattggacaggccgtgaaatgccggttcagtatattaaagagcaaatgtttgaataacctattgtgacagaagcgccgaaggacaatccgtcttccggcgctttatctttttccccctcctctctctttcttctcatgcgccaaaacgcttataatggatgtaacgaataaaaaccaagtgaggaatgcgacgtatgaaacagcaaaaaaaacgccgggtgacattgcagcaggtcgccgaacatgccggcgtctcaacatccaccgcttcattaattgtccgcaataatccccgaatttccgaagcgacccgtgagaaagtgctgcaatccatgcgggagctggggtacgtatatgatcgggtcgccgcgaatttacgatcacagacgtccacaacggtaggattgattatcactgacatttccaatacgtttttctcagagtttctgatcggcgttcagaatacgcttgaggaagtcggattaacggtgctgttaggcacgacatttgattccgtcgccaagcaggagcagctgatctcgaccatgctggagcacagggtcggcggattgattttgtgtccggtttcagggacggctgaggaaaccctttcccgccttgagcagcttgacattccggtcgtgctcgccgtcagggagattgccgatgccaactgtgattttgtcggagccgattatgaggaaggcacctataaggcagtgcgtcatttcattgagaaaggccatcaggagattgcgtttctgggcggcgtgaagcactcatcaacatggacgaagcgtatgaaagggtttaaaaaagcactccgtgaagcggatctggaagtgaaaaatgaatatgtcattgacagcgcgccgacccgcgaagcaggctgtgacgccgtgacggagctcctccgccggtctgagcgcccgaccgcgattttctgcttcagtgatttggtcgcattcggcgtcatgcaagggatcagaaaagccgggctcgttccgggcgaagatattgacattgtcggctttgataacgtgccggaagctgaaatttcttatcctccgcttacaaccgtttcttcctttccgcggcagtcgggaaaagaagcggctcaattgctgcatcataaaatcaccaattcccagcacaaaaaacaacgcattattctggcgcctgagctggtcatccgggaatcttcacaaaaaaagcggaacgcctgatacggcgctccgcttttatattacgcaagcagttttaatgattcgcggttgaatgccggaatgtcatccggtgtgcggcttgtgaccagctggttctggcagacgacgacttcttcatccaccacattcgcgcccgcgttttccatatcgattcggattgaagtaaatcctgtcgctttgcgcccgtccaatgctttcgcgttgatgagaagctgagggccgtggcagatagcgaacaccggttttttatcatccataaacgctttggcaaattggacgaaacggtcatccgcacgcagcatgtcaggtgagaatccgcccgggatcagcaatgcgtcaaagtctttcggattcacatcatcgatggacgcgtccactttcacttccgcttccccttgttttcctttgactgtttttcctttttcctgttcaattacggttaattcatgacccgcatctttaaaagctttcgcaggttcagtatactcgacatcctcaaagtaatccgttaatacaactgcaatttttttacccatagttactacctcctgcttgatgaagtctacataaatccatgtaccccagccacactaacatcaaacataggtaacgcgtttaccgcccgcctgttttacataggtcattatcctcattttttatcttttcacaagaatcatcatgaaatctatataaactttcacaaaatattcttacaatggtactgcatgacaaaatttgttgaaaggtggagaacaggtgagaatacagaaaagacgatgcagcgtcaatatgacactccgtattctgctgcccctagttatgatacttagtctgatcctcccaacatcacccattaaagcagaagaaaacaaatcctccagtgtgaatctcagcattttagccacaactgacgttcacgctaacatgatggactacgattactacagcgacaaaccgacaacggaattcgggctggcccgaacggctcagcttattgagaagcacaggcgcgaaaacccgaatacggtgcttgtcgataacggagacctgattcaggggaatcccctcggagaatacgccgtaaaatatgagaaaaatgatatcatttcaggcgcaaaaacccatccgatcattgaagtgatgaacagtctgcattatgacgcaggaacactcggcaatcatgaatttaattacgggcttgaattcctggacgggacaatcaaaggcgctgattatccgatcgttaacgccaatgtgaaaacagtaagcggcgaaaaccgttatacgccttatgtcataaaagacaaaaccgtcacggatgaaaacggcggcaagcatcagctaaaagtcggctatatcggctttgttcctccccagatcatgacgtgggataagaaaaatctcgaaggccgcgttcaggtcgaggacattgtggaatccgcaaagaaaaccgttccgaaaatgaaagctgaaggagccgatatcgtcatcgccctcgcccacagcggcatcgaaaaaaaagcgcagtcttccggagcggaaaacgccgtttttgacctggcaacgaaagtcggcggaattgacgcgatcgtatcgggccatcagcacgggcttttccctgatgccgaatacaaaggcgctgctcaattcgacgtcgataaaggcacgattaacggcatccccgttgttatgtcaagcagctggggcaaatatgcgggcgtcatcgacctccggcttgaaaaaacagacagcgcgtggcatgtggaagatgcaaaaggcagcatcgagccgattgccggcaatgtgaattcggaaaacgaaaccgtcgtcaataccgtcaaaaaagcgcacgaaggcactttgaaatacatcagagaacccgtcggccagacaaaagccgatatcaacagtttcttcgcccaagtcaaagatgatccgtccattcaaatcgtaacggatgcgcaaaaatggtacgccgaaaataagatgaaggatacggagtacaaagatctgcctatcctctcggcgggcgccccgtttaaagccggcgggcggaacggctcaaactactatacaaacatttccgctggcgacctcgccatcaaaaacatcggcgatttgtacctgtatgacaacacggttcagatcgtcaagctgaacggaagcgaagtgaaagactggctcgaaatgtccgcggggcaatttaatcagatcgatcaggcaaaaggcggcagccaagcgcttttaaatgacgcctaccgctcatacaattttgatgtcattgacggtgtcacctatcaggtcgatgtcacaaaaccggcgaaatacaacgaaaacggaacagtcattcatcccgatgcaagccggatcgtcaacctttcttatcaaggaaagcccgtcagcgccaagcaggaatttctgatcgtcacaaataattaccgcgcttcaggcggcggaggattccctcacttaagcaatgacaaaatcgtatactcttctgccgatgagaacaggcaggtcttaatggattacatcatccagcagaaaacgattaatccgcaggctgatcataactggtccatccttccggtcaaagggacaaatctgacatttgaatcttccttggccgcaaagccgtttgccgaccgcgcagatgacgtcgcctatatcggtgaatcacaaaacgcgggctacggacagtacaagctccaattcaaagatgatgaaccgggcacagatccgccgaaagatgacgcatggaaactcaccgttatgcatacaaatgacacgcacgcccaccttgataacgcggcgaggcggatgacgaaaatcaaagaaatcagaagcgaaaccgaccgcagcattttgctggatgcgggagacgttttctcaggcgatctctatttcacaaagtggcaggggctggctgatttaaaattgatgaacagcatgggctacgacgcaatgaccttcggaaatcatgagtttgataaaggtccgggtgctctcgccagcttcttgagcggtaacgggagcgcgtctgacccgtccgggaaatacaattttcaagcacctgactttccgctcgtcagctcaaatgtcgatgtgtccaaagagtcaaaactcagaccattcatgaaaaaagcagacacatttacggcagggaaaaagaaaaaagcaggcatctatccatatattctgcttgatgtaaacggagaaaaagtcgccgtattcggcttgacgacagaagatacgtccgtcacatcaagcccgggaaaaagcattgtctttcatgatgccttccaatccgcacaagatacggtaaaagaaatacagaacaaggaacatgtcaataaaattatcgccctgacccatatcggacatcagcgtgatctcgatctcgccaaaaaagtaaaaggcatcgacttaatcgtcggcggacatacgcatacgcttgtagataaaatggaaattgtcaaaaacgaagagccgaccatcgtcgcccaggcaaaagaatacggcgaatatttaggccgtgtcgatgtcgcatttgacaaaaacggcgtcgtcctgccggaacaatcctctcttcaagcgctgccggtgaatgagcagacgaaagaagacccggatctgaaaaaagagcttgatccgtttaaaaaagagctcgtctcagttaaaaatgaaaaagtcggttcaacgaaggtcgcacttgacggccggcgcgagcatgtccgctccaaagaaaccaatctcggaaacttcatcgcggacggcatgctgcaaaaagcgaaggaagcggccggcgcccaaatcgcgatcacaaacgggggcggcatccgcgcgggcattgataaaggagacatcacactcggcgacgtgctgaatgtaatgccgttcggcaacacgctttacgtcgcggatttaaccggaaaacagatcaaacaagccctggaacaaggattaagcggaattgaggctcaaggcggcgccttccctcaagttgccggtttaacatacacgtttacactgaataaaaagccgggacaccgtgttcttcaagcttcggccgtacaggatgacggcagtgtaaagccgatttctgataagaagacatacagagtcgccaccagtaactttgtcggtgaaggcggagacggatattccgtctttaacgaagcatcccataaagaagaccttggctttgccgactatgaggtcttcgttgagcagcttgaaaaagcgggaaaagcggtggaaccgaaagttgacggccgcgcgcaggaagtgtacctgccgacaaaacaaaaaaacggttcgtggacgcttgaagatgacagcgcatttgccgtctatgccaaaaacgccaacacgccgatcgtgtattacgataagaatgacggcgccaaaaagccgattgatctcagcgtgaccaaaaaacaaatcggcctgttaaaggacagaacatcggattcttcccttacgatcctgcatgacaagttcagcatgaaaatgccgatggcaaacgccgcttcagctgatacacgattcggcgtggcgccgaaaggaaaagttagcggggcgctttcaaatgtatacgactttacaatgaagcagaaaaacaaagacatcaaaacattcaaagcgccggtaaagctcaccctgcgcattgagaatatgaaaaaggcgaaacagcccggcatttatcatgtagaccggaaaaagaacgtctatacaaaaacagacaacggttcggtttcacacgatctcgtcacgggctatacaaatcatttcagtgaatacaccatattaaacgcaaacacgaagagcgcgccgccgacaagcggagatcacggctccggaaagcagccaagcggacaaaaaccgtcatccggccctgcgcaggacggagtatcgccgggcggcctgcttcctgatacagccacaacgatgtattccatccttcttgccgggttactcatcagcgcgctcggaacggcactgtatctgtaccaaagaagaaaagcaaaaaaagtgaacgaagcataaaaagaccgcttttatcgggcggttcatcccaagagctctcctgatctgatatcaggagagctttttctgccggtccccctctgagtcgacagccgtacggccgagtgataaaatatgaacgttattcgcgaaagactgcatccgcatcgtttaacacttcacggcggagcctctcttttacacggcgccgcctgtttggaggactttttttgaagattacaggaaacaaacgaaaccgcatgtcttacaagaaaaagctgttttacgtgataacagcgctttgttttatcagctcgatcatttttgtcactcacaacgcttctttttatgagcggccgattgccagagtgacgaaaacaactttggaacaccaggcaaacgtacaggacatgcataaaaacaaagataagattttcaatcagacgatcactgccagacttgaaaacggcagtcagaaagggcagctcattcatttgtccaatcagtattctttatccggagcgaatgatcagaaatattcgattggcgatgaagtattcgtttctattgataaagggaaaccatcaaacaaagatatatcgggaagcattatagataaaaaacgggataaacagcttttgctgatcgcttgggttttcatcttcaccttgcttatcgtcggaaaaaaacaaggcttcttttcgatcgtcagcctgatgtttaacgccgttttactgtcgtttgcattagatttgtacaggaagcatcctaatatagggttaatttttatctgcggtatctgtattctcatctttacggtcatctcattgctgcttgtcagcggttttcacgcgaaaacatatgccgccatagccgcgacgctcgcaggcactttcgtttccctgctgattacgtatctggtgatgctggcaaccggagagaaaggtctcagatatgaggaaatgcagtatttaacccgcccttatcacacggtgtttatggccggggtatttatcggatcactgggagcggtcatggatgtagccattaccatgacgtcatctgtcttcggattatatgaagaaaacaagggtatctcattacaagctctcagacgttccgggatggagatcggaaaagacatcatgggagcgatgaccaatattctgttttttgcttatataagcggctctattccgatgatgcttttgtatttgaaaaatgattccccgataggattcactctttctatgaacatttccttggaaatagccagagcattggccggggggatcggaattgtattaaccatacccgccagtctgtatgcttctgtcttttttattaaacaaaagaaggcaagctcatgaatgtcatcgtaattctcgcggcgattttatttctattaatggtcattatcggcggaaaaaaaggagcgaggtcttttattgcgttattcttaaatttcggggttctctttctcaccattattttcatgacagatccgcatatcaatccgattgttttaacattgctctcttccgccgtgatttgcagcattactcttttttatattaatggaggaaacgtcaaaaccgtaaccgcctttatttctgcgatgctgaccattgcattgctgctgttttttattatgtccgtaacaaaacatacttcgattcagggattcggtgaagaagaattgggggatatcggcatattcacactgtttgtcggggtggattttgtgaaggttaccgcagctatgatcatcatgggcacgattggggcgattactgatgtcgcgatttccattacttcacccatgcgggaaatttacagtcataatccgtccatgagcagaaaagaactgtacacattcggattaagcatcgggagagatattttaggaacgaatacgaatacgttattctttgcttttttcggcagctatttggctttaattatctggtttaaagacttatcatactcagctgaaaaaatagtgaactcaaaagtattcagtgcggaagccgtcaccattctttgcgccggaatcgggatcggcatcatcattcccgttacgtcctggatcaccgcctgttttttagcaaaaccaaataaacattaaaagctgccgggacacgcccggcagctttttttatcttatacccactttacaacgtcttttgaggcagatcttgttttcgggcgcggttctctgacacggtagccgaatgcggccatgacagagatgtcgaaacttccgttttccagaagcccttcttcttcaagaatccggtggatctctttgtagttgaagccttcaacagggcaggaatcgatgccgatctgcgcagcggctgtcatcatattgccgagggcgatgtaagtctgtttggatgcccagtcaaacagcgcgcgatctgattcaagcagattgaaatcatttttctggaagtcttccgttttgctgatatagccttcatacatatcttccggcatttttttgacttcccgcaagtggtttttgacatagtcggcgtcaaaacggatatcctttgccgtccgggcaagcagaagtacgaaatggcttgcggtcggcagctgcttttgcgccccccatgtgaactcgcggagtttttcacgaagctccggattttgaacgacgacaaatttccaaggctccaaaccgagtgagcttggggataatcttcccgtttctaaaatgaattcaaaatcgctttctgaaatttttttctcaggatcaaattcctttgtagcgtgtctgaattgatacgcttcgatgatctgctgttttttatctgacattcatgatctctcctttttatctcgttatgtactattgtagccattatttttgaaagtaccagtacgcacatttttgttggatagtattcattttgatactgacaaaaaaacgggctgccgcggcagtccgtttttatttttctcttctcgcaaagtcgacgaaacggaatttatcgagcctgtgccggctttccgtgtactgaaagaggctggtatcctccaaaaagacgcggtttttcacgaccgccatatggctgaacccgccgagatccaaatacttccggtcttcctcccccgccggctccacgacaatttccttttgcgcgtagctgatggacaggccgagctctccttcgagatactcatagatcgaatcttcacaaatcgccttcgttaatagaggcacatgttttttcacaaagtaatccttgtccaaaataatatgttctccgtcaatccgtcttgatctgacgacttcccacaccttttcatccgccactgtaccaagctcttttgcggcttctgagggaggcaggatcagcccgagacggtgaacctccgttcgcgtctcttttccgagcgtttccgaaagctctttgaagctgatcaggcctgagacgggaaagcgcattttttctctgtctaatatgacggagcctttgcctttgattttctggatgtagccgttttgcgccagcatattgagcgctttacggacggtttctcgtgatgtgccgtattgatcgcataaatcattttcagacggaagaacgtcttcagccttccgctggccgctttcaatctgccgcaccatatctttatagattgtgatatatttattcactttcattcatgaccacccagattagtgtatcacgcttttgtcagatgataaacgatcgattcatacggacggagcgtcaatcgttccggccgcccttccctcggttcatcattcgtcagcagcaccgtaaaccgccagccgtccgtgtctttaagcggaaccgtaaagtccgcttctttcccgtagaagttgttgatgcacagaagtttttcatccttgccgtgtctgacgtacgccagaaccgccggatcatcttcagcaagcagctcaaacgttccttcagtcacgatgtcatattcctttctgagcttgatgagcttctgataatggtagaaaattgaatccgggtcccgcaaagccgcttccgcgttaatgtcccgataatcatccgccgccggaatccaaggcgttcccgtcgtgaagccgccgttcggcccgctgttccattgaacgggggttcttgcattgtctcttgatttctcttttaaaatggcgataatgtctttttctgacacgccttcttccttcatctttttgtaaatgttcagtgattcgacatcgcggtatgagccgatgtcatcgaacttcggattgcccatgccgatctcctcaccttgataaatgtaaggcgtgccctgcatcatatgaatggccgccgccagcattttggctgatttcgtccggtatacgccatcgtctccgtatctggatacggcccgcggctggtcatggttgcaccagaataatgcgttccagcctccgccgttttgcatctccgtctgccaaaacgctaaaatccgtttcagcttcagaaaatcaaacggagcgagcgcccatttttcaccattcggataatccacttttaaatgatgaaagttaaaggtcatatcgagttctttattttcagggtttgtgtaccggatgcagtggtcagccgttgtcgaggacatttcaccgaccgtcatgctgtcatatttcgaaaacacttcccggttcatctcatgaagaaattcgtgcacgcgcggcccgtccgtataataagggcgcccgtcacgaccatcctcggcatcaggaaacgattggtctttagaaatgaggttgatcacatccagccggaagccgtcgatcccttttcggaaccaaaaatgcatcatgtcgtaaacctgttttctcatctcttcattttcccagttcaaatcggcctgcgacacatcgaataaatgcagatagtgctggcctgaggccggatcgagctcccaagcggaaccgccgaattttgattcccagttgttcggcgcccggccgtcttccttgccgtctttccaaatgtaaaaatcccgatacggactgtcgggtgacgaaaccgcttctttgaaccactgatgctcgactgatgtatggtttacgacaagatccatgacgacctttattcctcttttgtgcgcttcatcgagaaggcgttcaaaatcctccatcgttccgtattcttcataaatggtgcagtaatcgcgaatgtcataaccgttgtcattctgcggcgaatcgtaaatcggcgtaagccaaatgacatcaatcaaaagcttctgcaaataatcaagcttctcgataataccgttcagatcaccgatcccgtttcccgtcgtatcattaaagctcttcggataaatttgatataccgctgcctttttccaccatggtgtgctgtctgttttcatttttcttcaccgcctgtattgttttgaatggaaagggaaaagggacagcctgttagaaggcgccccgcaggttttctatttttgccgtttcagccgcgcatacccgtatgttcccgcaaacgggagtatcagcacgatcagcattccgatcgcaaacggaccccagtaccggctcataatggagaagatccccgggacgccgccgactccgaccgagcttgcgagaacgcctttgacggagatgaacatccccgcaatccccgagctgatcatggcgatcacaaacggaaatttgtaacgcagattcacgccgaaaatcgccggctcggtaatgcccaaatatgcggaaatgccggccgtcagtgaaagcccccgctgttttttatcttttgtaatgagcatcatggccagagccgccgatccttgagcgatatttgataatgcgagcatcggccataaaaatgtgccgccgagctttgatccgattaattgaagatcgaccgcgagaaacgtatgatgcatccccgtgatgacaagcgccgaatacagccctccgtacagcaggcctccgatggcggagaattggccgaaaacggcaatcaatcccgccgtcagcgcgttaccgatcgcaaaggtgatcggaccgatgataacaaaggatagaaaaccgatgaccaaaagcgtcaccggcgcgacgaccaacagctgaatgccctccggcgtccgtttcgtcaaaaagagctcaagcctggcaagtaaataagacgccagcagaatcgggagcacctgaccttgatacccgactttctgcacctcaaggccgaacaagttccacaccggaatatcgccgctctgctcggcggccccgtatccccatgcgtttaacagatcaggatgcaccagcatcagcccgagcacgatgcccaaaagcgggcttcctccgaaccgcttcactgccgaccagccgattaaagccggcagaaaagcgaaggccgtccccgcgatcagattaatcatattggcaagatccgcccattgcggatacacttgaacaatcgatttcgtgctgtaaaaaatgccttccgccgttaagatattgttcagacccattaaaagcccggccgtgacgatcgccggcaagatcggaataaagatgtccgcaagcgttttcatagcacgctgtaaaggattcattttttgcgatgccgccttcttcacgtcatccttggacgcttccccgatccccgtttccttcactaattccgcatatactttgttgaccgtcccctgcccgatcacgacttgaaactgcccgtttaccgcaaaagatcctttgacaatgtctattgcatcaagcattttttggtttaccttggtttcatctattaatgcaaaccgcaaacgcgtcacacaatgagtcgccgcctcaatattttcgattccgccgacagcttcagcgatctgccgcgcagcccggttaaactcacccatgccaacccctccgtaaccgttttcattttgtctcaaaaaacttgtatatacatgtttatgactctattgtaatgatgtatatacatgtcgtcaatctatttttatagcgctttcatcacaaatatactgcgaaagaccctgaaacaaaaaaagccccgccggaaccgggccttgacttcttgtttggtcgggaacatgtccgggcggaattcacaacaggagcacaaaaagcatacagtactgtacaactaagttaaagaggtgtgaagagatgccatccactgttatcaacctgtactatttgaagattaacagtatttctggcaacggatctattacgattggggaagcggcatacaacagtcccaccacaaataacaaatcacaaggactgaactcttcattcggcgatacgtcacctatagaatcgatgatggagaacttgttaaatgatcctgatgtcaacgaccagacagccatcggaaccgcagataccgcaaatattacgccggtgccgcccattatagattaaaggggtttttatgaatgccttaccaaattaacgtcgtcaatataaaagtaaacggagcaacgcaaaacggaaacgtcgatatcggtcagaccgtacaaaacagccacaccgccaacagcaaatttgtcggcgcgaacttttctttaggggatttttcgccggccgccggatgtttgaattcgggccatcttgaccctgacgtgagcgatcaggatcagatcgccaacccgtcaatgccgatcgcaaatcaaatatagggaggttctgccgaagtggatatcgaaaaaatgagaaagtggcttgagattacgaacgagcacaagcccagcgacttttggaccaatgtcctgaaacggaaatctcccgaagattttttctccttacaaaaaaacaccctgacttatgatatttatcaggatgaacagcacacatttgtcattgtggaaatgcccggcgtttacgaagaagaattgacattgaggctgctgtcaagaacacggctgcatataagaggaaacatcacacccctttttccgaagaacatgggcgtctgccaaaaccggtattacggggaaatcgatgagacgattgagcttcctgaaccggctgagccccacctgttacaggcgcagtgcgtaaacggcctgctccacatttcctacccgcgccttatggagcacattccttttcagaaaaaaatataaagagccggcttacgggcggcccagccgtctgtacactttctccttataatgagaagatgcgggttttgagaacatggctttctcctccgtcagtttgtcgagtctgacttgtttttccgtccgtttgttccgcaggtgatcccgctcctgttcattgcggcacttggcgatcaaataatcgagcgtcatcagctctttcttcagcgcgccctcatcctcggcgatcccggcgttttttaatatgcggtagcccattctgagcgactccggaagatgtgcggcatcgtctttcggcaggggctttcccattccattgatgccggcgaactctccatccttaatggcgcgcttgattttatcttcagccacgatatgcgcaatatccatcactgtttacctctttcttcaatagaatcgggtgtgatcatacggaaattcacatcccagtttgtgccatttgtgttttttaaagctgtcattcaacagatcaaccgccgctgcgacagcgtttttcgccctttttccgatgagccttttccaccttttctatttgctggtttcatggtatattgattacgttcgttttttctatcgttccgtgtaaaccgtgatcggaaaaaaggagtgtaacaatgaaaacatttataaaagaaagaggacttgccttcttcttgatagcggtcgtgttattgtgggtgaaaacatatgtcgcttatattttaaactttaacctcggcatagacaacacgatccagaaaatattgctttttgtgaatccgctgagctccagcttgttctttcttggatttgggcttcttttcaagaagaaattacagcagacagccattattgtgattcattttttattgtcttttttgctttttgcaaacatcgtctattatagattctttaatgatttcattaccatcccggtcatgatgcaggcaaagacaaacggcggccagctcggagacagcgcgttctcgttaatgagatggacagacgccttctacttcctggataccgtcattttgattattttggcccttaagatgaaaaaaccggctgaaaaaccggcgaagaaatcattcagaatcgttttggcttccgccgtgcttgtgttcctgatcaacctcgccgtcgcggaatccgaccgtcccgagcttttgacacgctcatttgaccgaaactatctggtgaaatacttgggcacgtacaactttacgatttacgatgccgtgcagaatgtgaaatcaaacagccagcgcgcgcttgccgattcaagcgatgtaacggatgtggaaaactatatgaaggccaactatgacgtgccgaataacgtctacttcggaaaagccgaaggaaaaaacgtcatctacgtctcattagagtctctgcagtcctttatcattgattacaaaattaacggcaaggaagtgacgccgtttttaaacaaactggcgcacgataatcaaacattctactttgataactttttccaccaaacgggacaaggtaaaacatctgatgcggaatttatgatggagaactctctgtacccgctttcgcaaggttcggttttcgtcaataaagcgcaaaacacgctgcagtccgttcctgcgatcttaaaaggcaaaaagtacacgtctgccgctttccacggaaatacgcagactttctggaaccgtaacgaaatgtacaaatcggaaggcatcgataagtttttcgattccgcttattatgacatgagcgaagaaaatacgaaaaactacggcatgaaagacaaaccgtatttcaaagaatccatgccgctcttaaagagcctgccgcagccgttctatacgaagttcattacgctgtccaaccacttcccgttcggaatggataaagaagacacggacttcccggcgggagactttggcgattcagtcgtcaataattacttccagtccgcgaactatctggatgaatcaattgaacagttctttaatgacctgaaaaaagacggcctgtacgataagtcgattatcgtgatgtacggagaccactacggcatctccgaaaaccataataaagcgatggcgaaagtgctcggcaaagatgagatcactgaatacgacaatgcccagcttcagcgggtgccgctctttatccacgctcccggcgtgaaaggcggccgcaatcataaatttgccggtgaagtcgatgtcgcgccgaccgttcttcatctgctcggcgtcgatacgaaagattatctcatgtcaggttctgatatcttatcgaaagagcacagagaagtcattccgttccgtaacggagacttcatctcgccgaactatacgaaagtgtccggcaagtattacgatacgaaaaccggaagacttttagatgattcagaagtcgacaaaaaagaagactctctcgtcaagactgagcttgaaatgtctgataagatcatcaacggcgatctgcttcgtttctatcagccgaaaggcttcaagaaagtggatccgtcacaattcgattatacgaagcgtgaagattcctcagcagacgatcaaaaagaataaacaaaagccagatcattgatatgatctggcttttttatgttcagctcccggcggcggccatagtgcgcttttgcaggctgtcggaaagaactgaataagcgattactttctttttctgctgcttgacgacatctacatgatcttcgtagctgtatacaaacaccgtcacatctttttttccttttctcgtcttaatgacaagcggatcggctccgttttgcggatgaagataacgctcttcatcccctgggtatatataatgccgttcgataaacacggcttcgttaaaatcatcaatcacccgtcgtttgtcttcgccttccagacgttttcccccgagggaaacggcagcggactcgtcactgagctttgaatgggtttcaaacttgcggaggatccattccaccgctccggtaggaaggcatgtcagcacaatcttaatcaggcttatgacaacaattgaaacaactgcaatccatgtcaccttacatcatctccatacttgttctacatgaatcttaacatagaaggaaacattgttttttgtacattatgtgaaacttgatatatgttcaaaaaaaatccggatcacataggtgatccggatttttcaagtctgcttctgatcgtcaaggcggacggcctctctcagctcttccgcgacaaattcgacgttcggcccgataatgacctgcgccgttttattccccgttttgataaccccttttgctcccgcttttttaagcgccgcctcattaatgagagacgtatcctgcacggtcagcctgaggcgggtcgcacagtgatcaatcgtttcgagattttgcctgccgccgagccccttgagcatggcatgttcttcgacggaaccggccgtatcttcactaagcacttcttcctcttcctcatcatcttcccgtcccggcgttttcaagtttaacgttttgatgagcatataaaagacggcaaaatagatcaccgcataacaaagcccgacaacgagcagcaaaagcggtttttcggcaatgccgtagctgaggagataatcgatcgcccccgccgagaatgaaaaacctgacctgattccgagaacattcacgataaataaagagaacccggttaatatagcatgaaccccgtacaaaagcggtgataaaaacataaatgcaaattcaatcggctctgtaattccggtaataaatgccgtcagcgcgagaccgatcatcattccggccgtcgctttgcgcttacttggcttagccgcggcaatcattgccagacaagcggccggaagcccgaacatcataatcgggaagaatcccgtcatataagtccccgccgtcggatccttcgcaaagaagcgggccagatctcccgtttttccgtgaaaatcgccaaactggaaccaaaaaatattattcaacacatgatgaagaccgaatggaatcaaaagccgattaaaaatcccgtaaatccccgcgccgatcccgccaagcccgatcatccattccccgaaggacgtaatcaccgactgaatcggcggccacacaaatccgaagatacccgccaaaataatggtaatcagcgccgttacaatcggaacgagcctgcgcccgctgaaaaacccgagatattcgggcagcttcgtatccttaaagcgattatacgtgtatcccgcaattaaccccgcgataatccctccgaaaacggccatattatttgtcgaattgattgattttacagccgcgtccagcatgatataagaaatggctcccgacagagcggcggccccgttgctgtctttcgaaatcccgatcgcgattccgatcgcgaaaatcagcggcagatgatcaaataccgcggtccccgccgcgtaaatgaacggaatatttaataagtcctctctgccgatggccaaaataataccaacggcgggcagaacggcaatcggaagcataaaagactttccgagtttttgcaaaaattgaagcattttacccatcccccttcttttttcttaaatataccacataagttatctagtgatctataccaattttccttcatttattcacataaggcttgttggttttctatttataaaccagttgtggtaagcttgaatcagatgattaaaaatagaaagcgggaatgacaatgattgtaacgaacgatcaagaattagaaggccttaaaaaaatcggcagaatcgtcgcgctggcgcgtgaagaaatgaagaaaaaagccgagcccggcatgagcacgaaagatcttgacctgatcggaaaggcggtgcttgacgagcacggagccgcttccgctccggagaaggaatacgatttcccgggcgtgacatgcatcagcgtaaatgacgaagtcgctcacggcattccgagcgcctctaaaatcttaaaagccggagatcttgtcaatatcgatatttcggcggagttcggcggtttttattccgatacgggcatttcatttgtgctcggagaaggcgatgaacgtctgcaaaagctttgtaactgcgcggcatccgcatttcagaaaggattggatcaggcaaaagccggcaaacgtcaaaaccagatcggcagagccgtctaccatgaagcccgctccaacggatttaccgtcattaaaacgctgacgggccacggaatcggcagaaacctccatgaagcgccgaaccacatcatgaattactacgatccgtttgataacgcgctgtttaaaaacggaaccgtgatcgcgcttgagccgtttatttccacgaaagcggaaacgattgttgaagcgggagacggctggacatataaaacgccggataaaagccttgtcgcccaagtggaacacaccatcgtgattacaaaagacaaaccgattattttaactgcattgtaatgtttcatctccctcccgaacaggtatacaacaactaacccgaaggagggagacgcatgaaaaaagataaagaaaaaatcaaaattgaaaacgaaatacacgccatgcacggcgtaacgaaacagcagattttagaggatttcgaggaatttaaggcgtaccttcatcagaaaatttccgccggaaaaaaactgggtctggatgacagcaaaatcatcaaaagcgccgccatcctcggggactatctcgccaaacacgaggagccccgcaatgcggaagaaaaactcttacaagaactgtgggacatcgcggatgataatgaaaaacagcatttggcccagcttctcgtcaaacttgccggacactgatacagtgcccggcttttttatgctccgttataagagttgtgctacactggacatatgtctgtgaaaggagccatttttcaacatgtggtttattatcttcgggtttattttctttattgaaagcatcattctcaccgtttacggggtgaagaaaaagaaggggatgctgatttatttcggcgtcgttttcggaatcatgacactcggaacggtgctgttaaaattaaccggccattaagcatgaaaagaccgccctttacatatatatgtaagaaagctttacatctctgaatcgaaaggctcagtttttgcattatcccttttcagcgtctttttatagatgttacaatgccaaaagtttggcaaaaactgaagaaacctccccagcgggagaacggagaaaggagttttctgacatgcattatggcagtaaaggctggtatgtagaagagttaaagaaaaaaggaattacccactatgaaggaagaaagcttcaaagcttcaaaaagtacttccttgccaatctgctggaaacaaagaaacaagcataacgtaaatcagccgtgctgtcagtgcagcacggctttttttctatacattagtgagcctgtccctttttttaaggaaggactccctccagctttctgacagcgcttcttcccgcagtatttcttcaatcgctgacagattgtctgaatcacggtatttcacttcgttcgcataccagacggaaatgctttctttgcctctcgacagacgcttgaggacgggacgcggatcgacatatccttcttcaagcaccctgaaataaaagccggtaaatcccgtctgctgtacacggagcaccatatctttgatgccatatttgagcgcgagtttgacgcagggctggcgcggctggcttacttgaacgacggcttcacccagctgaaagatgtcgccgatccacacgtcttgttcggccagtcctttgaccgttacattctctccgaacgcggcggcgggaagttttctcgcgagcgttgtttcccaatatgaataatgctcggcgggatacacgcacaccgctttatcgggacctccgtgatgcttcagatcagcctgcccgtccccgtcaaaatgggttttatacagcatgacgggagaatctgcgggccgcttgatgatgcctgaattgatttgtctgccggcaaattcatgaattgcgggctttccgagattgatagataagacagaatagtcttgcgtcatctcgttcacatcctttgcgaaatatcctacctttcctttatcatagtaagaaaaaggtggtttttccatgcttcagtatcatatgattgcagacggccgggttcagggcgtaggttttcgctacttcgtccagatggaagccgacagacataagatagccggctgggtaaaaaaccgtgatgacggccgggtggaaatccttgccgaaggccctgaagagtcgttaaaacaatttgccgaagcggtcagaaaaggcagccccttctcaaatgtcacaaacgtaaccatcgaagaatcacaccgtctgaaagggtaccgcaccttttccatcagttactgataaggcttgtcctgataaaaataattcggcttcacaatcgtattgtcatatgatttatggaaaatgtgggtggaagccggcgagatcggcggaatcagccaggtccagtcgcccgtcagctttctgcccgcgtcttgttcctgttcttcaaagcgtttaaattgattcgcggccgtatggtgatcgacaatgctgacaccgtgttttttgtatgaatagagcactgccttattcagttccaccagcacctgatctttccacaggtcggtattcaggctggcggaaatccccatgaccgaagcggcttttttgagcatatcataccgcttttcgtcagcaaggttccttgcgccgatttcagttcccatataccatccgttaaaaggcgccgcgttgtacgacagtccgccgatttcaagcctcatatcggcgataatcggaaccccgtaccacctgagatttaaatcggcaaactcttcaatatccggatgggtgatcggcacttctttcacgagcgtctgaggcaggtcataccagaccggctgcccgtcccctttcatccggaaaagcagcggcagaatatcaaattcggtccgcttcccgcgccagccgagtttttcgcagacagccgtcagctcatatgatgccggatcaccgactcttcctttttcagtctcatatcccgcatagcggatgagctggtgattccagatttccacttgtttctccccgttcttctcaggagggaaaatcgtaatcgtcggtttaatttttccgccgttcgtggcgatttcaatatgttcaaataatgcgtcacgcacctcttctttcgtgttcacattgcgccggtcaatgacgttcagcgattgccagaacagacgcccgatacagcggttgctgttgcgccacgccattttcgccccgtgttcaagctcttccgccgtatggacgtaacttcccgtccgatctatctcatcttttatcgcgtgcagtcgcgcgttgatttgcgattccattccgagttcgtgatagcagacatcaataaaatccttcgcctcatcccaaagtatttccgtatgtttcaaaaaactctctccttcaatttacatctgtttcccattgtatcgtttttaggtgtgaacacaatggtttttttgtatcatactggaaactgcgaagaaaaaacacctgtgattttcgcaggtgttttacaaaacggaatgcagtttttcagccagtgtaagcaaatcctcacggtagttttttcccgtcatcggaattccgtgacccgtcaaaagcgcttccggctccagttccgccaatttctgaacggatgcggccgccgtctgcgtatccgctgtaaaataggcgggcggaccgtgaagctcttgcttttgaatgacaacgtccgcaagcgattcctgttcaacagtgatcacggcatcaccggcaagcagcacgcggtctttatcccggaataatgaaatatggccgggtgtgtgaccgggcgtatgcacccatttccattcttcaagaaacggaacggtaccgtctgaaggcagtgcctgaacggacggaatgcggatcgtatggcgcggaaacagcggtgacagctttgcgacaagcccttttttcgcatcgggcctggcaggcggataatccgctttccccgtgacgtacggaagctccttttcatgaatgtaaaccggcacattccaaagctcaagcagttcttcaatcgcaccgacatgatcaaaatgaccgtgtgtcaaaatgaccgccttcagctcatacccctctttgaaccggcgtttcatttcatttgtaatcatctccgacgattgaggcattcccgcgtcaaccagaatgatttcccgcggagctgagggattttcgataaagtaaacattcgcaatctgcacggtcagtccgtaaacgccgtccgccgctttaaaaccggcgccgcttctcactgaaaaaagcggcataaacggatcactcatcatggcacctcctctgatgcctttagtgtgcgacgaaccgggtgttttatgttaaaaaatcgtgattgcgccgatgatgagcgcaaaggccgtcatgacgataacggcaagaaccgcccatttcatcgcaaatttctgatgttcatcaatggtgaccccggcaagcccgactaataaatgcgtcgacggcacgagcgggcttaacatatgaatcggctggccgataatcgaagcgcgggcgatttccaccttatctacaccgtacgccacggcagtctcagataaaatgggcagcacgccgtaaaaataggcgtcattaggcatcagaaacgtaaagataccgctcgttaaggcaacaatcgccggaataaaacctcccatctgttccggaataagcgatacgagggaaatggccatttcatcaaccatcttcgtccccgttaaaattccggtaaacacgcctgcggcaaaaatcatcgaaccgatcgcaagcacattgctcgaatgggctgaaatgcgctccctttgatcattaagtttcggatagttgacaatcagcgcgatacaaaacgcaatgatgaacagcacggttaaattcacttttcctgacactaaaaatcccactaaagaaagcgttaacagtaaattgaaccaccacagtttcggccgcttccattcatcttccgcagccgcagccgtttcatttgtatgggacggctgctttaattcgatcaccccgagccgtttcctttccatccttccgagtacataagcgaccacaatcatacacaccattccgctcgcgatgacaggcagcatcggccccgtcagctctgccggatcaacgccgagcgcactcgccgcacgcggcgccgcgccgccccatggaatcgtgttcatgatacccatgccgaccccggcgattcccgctaaaataatcggacggattccgagcatgatatacaaaggcagcattgcgcttgtcgtaatcatatacgtcgtcgagccgtctccgtccagtgcgacaagcatggtcaaaacggctgttccgactacaattttgagcgggtcgcctttaaccagctttaaaatacgcgacaccatcggatcaaataaaccggtatcaatcataatgccgaaataaagaatcgcaaacataatcatcactgcgatcggcgccacctgttcaataccggagatcatcatctcgccgacccggttaaaagaaaacccggcaatcagcgcaaacacgatcggcgttaatacgagcgccgttaacactgaaagccgttttgtcataatcagcaccataaaaacaagcatcataagaaagcctaagattgctaacacagtatgtccccctcatcatgaatacgcttacattttaaaggcccgatcccctttatccgcctttttgctatcttatgagaattggatattgaagtaaatattttggattttaaagatttttaattttttataaccttttcgttcattttgttcatttataaatcaaaagccttccgcaaatatgcggaaggcttatttttcgctgctcatcatctctttataaaactcggtctgctcttctaaaaagcgttttgcgccgctgctgtttttataaaagctctcccaatcccgttttttcaacatttgcttccactccgcggatgaagtaatctgtttcaaagcctgatcccaataggcgatctcgccttcggtcatgtctttcggccccatgatgcctctccagtgcgcaaagacaaacggcaccccctgctctttccatgtcggcacatcgctgaagccggagagccttttgtcagacgtaacggccgccaatgtgattttccctttccgataggcgtctctcgcttctgaaatggtcattgaggcggcgtctatctcgtgactgataagagcttcaatgacttcattgctgcttccgtattgaaaaaagcggatatcaaacggagaaattccggccatttccgccgctctcgcaaaggagagctggtcatcatttccgaggccgggcgcaaatccgatttttatgccgcccggatttgctttaatatcgccgagcagccgctttccgctttttatctttgaatccttcggaagagcgacggtctgccactcttttgcgataatggccaaaggcgtaaaatcagctgccttcagccggctttgtcccaaaatttcattgcttaacagcagacttgaattcatactgatgacatccgtttttcgttcgtttacatatttccagccgctgtctccgcctcctccgggtttatagatgatctttacgggccggcctaatatttgcttccgctctattaccgattgcaaagcttttgccgttacgtcccagcccccttgaggcgctgccgggacgactatttcaaccggcccttcagctgaacggatgcccgccgcctgccgtccgtcaaaagaaaccagcgccgccagcatgacaagaagcactcccaaccgcttcatttctcccatcccttactcatgtgctaaataatatttccgttccggcctgccgataatgccgtactctaattcagcgagcgcttcttcccgagaaacgagaaactcggcgtagcgccgcgccgttgttctggaggcacccattttttctcccagttcttcagccgtcatccctttttgggccgttctgagcgcgtttttgattttttgaagcgtaatcgaattaatcccggtcggcagatcattgtgctgtttttgttctttctgaccgcttccgaaaaacatgtcaatcacggactggctcagctccggctgtgagtgcagccattctcttttttcacggtactgcaaaagcacttctgtaaatttatgtgccgacaccggttttatgacataatgggcaacgcctgatctgagcgcttcctgcagcagccttgtttcggcagaagccgtaataatgatgatatcaacggaaggaaaacggccgcggataagcgggagcagatctgttcccagctcatccggcatataaatatccaatagcagcagatcaggctgccgtttctcaagcagcgatatggtgtctttggcattgattgctttgccgatgacattgaatccatcaagatgttcgataaatttttcgtgaatttgcgctattcgaaagtcgtcctctgcaatcgcgatgttaatcacaccgattccccctttggcctttctttcggtataaacaccgtaaatacggcaccgccgctcttttgctgcgaaatctcaatcgctccctgcaactcactgacggcttctttcagattggctaagccgtatcctctccttgtcccctttgaagagtagcccttttcaaatatcgtttctgttttttcctgaggcacgccgtctcctgaatccgccacttcgatgacgatatccctgccgatatcggtcataaaaaaggatacctcttttttctctttttcggcgacggcttcgaaagcgttatcaataagatttccgatgatcgtaatgagctgggatgaacccacatgctccggcagcgattctaaaaagctgttttcatctattgaaagcttcactttcttctcagacgcctttcccatttttcctaatagtatggcctgaacccgctgtgaatgaatgttttgaaagaggatttcgtgctgttcattctggatggcgtactcttcttttatcagttcaatggcttcattatattctcccagctctaacagaccgagtatcgcgtaaagcttattcgagaattcatgcgtttgcgcccggagatcctccgagtattttttcatttcagtcagcttgttaatcagtttcttgagctccgttttttcgcggaagctgatcaccgctccgtatacttgtccgttctgcttcatttctttcacgtttaagataaatactttatctccggcacgcacctccacgttcggcggtaattctccccctgccaacaccggcatgagctttgcgcccggcatgatttcttttatatgccttccgatcatcggttccggaagattcagcatatcagccgcagataaattcatcatggttaccgcgccttctttgtttacggcgataatcccttctttcatcgcaaggagcatcgcattgcgttccctgtacagcgctgcaatttcatgcggttcaaggccgagtgtatctttacggatgctttttgcgagcgccgccgctcccccgatgccgataagaaacaccaaacatgcaaaatagcctaaatgccgcaaatgcgccttcatatctttttctatctcatcttgtagaaattcgactgtcaccgttccgacgacttcgttatgatttttttcctccaaaataaccggggcgcttccccggacggccttcattccgtcggaaaccggagacccgccgaacatgacggttttattttgcagattttgattttctttcggaatactgcttcgggccgaatgaaatgcaacatgccctttttgatcagtgatgtagacggcgtgcgcgcctgcctgttctttcatttgttcaatgacgtctaactttgtaaaagcctcttgatccgcaagccggaacgcctcttttacgggaggcatatatgaaatggtttttgccgtttgcaccgccagctgttcagcctgcttctgcccttcctttaattgctgaaaggcaaatataaccgtgagcgttccgatgacaagtattaataaagccgtaattaatccggcgattttcatttgcagagagacataaaaccgcttcgcttccaacacagcaccagccgtcctttcctcctaaaatcataccattttttaaatcttcatttctcatttttgagaattttcgcgatctttttctcttgtcatttctttcaaaaagtgcagtctggtataatttccctcaagagagataagaaggatgaactttttataatcgctgcgcaaaaaaagactgacaggagccagtctcgggatgtttcacaacggacgtatattcagttgacaaagtgtttctctatgatggctgagatacatttgaatgaccggaaatatcaatcaattttcctttgacggccaggcgtccttcggttcttaccgccttgtcgcatgtgattaatgtaatctctttatcttttgtctcctgaattgcgtttgcttctatttctgaaatcatggtttttgatgttacagaataaatatagtcttttctaaagtcggtaatcacgatttgcgcacctttttttatgtgtaaaagagggccgaacaataggttctcctgcttcagatggtggcctgccaacgggtagtttccctcgcccattttctgatccggacgcatagttgccgcgccgatcagcaggttttcattggttgtgccttttaaaatcggaaggtctaaatcgatgctgctgatggttatccgtccgattatcggtttcggtttgcgattaaaacttgactgaactgtttccctgaaaccgggcggatgaatggattcaaattcatagtccgcttttttcatgttatttttccgcgcttgttctgcggtcaattccgattcaatttggcttttactgaggtacgcaatcaaacagcctttcatgagaggagaggaaatgagaagcagcccggacaaaataagaacggcaatgatcatttttttaaccatgaagaaaattcctttcttgtacgtcatgcggtgagtatttggtgagaaatgattctctttttaaaaaagcacctgatcgattcttacatgatcaggtgcgattacgtctatctattccttgctttcttctttcttgatacaacagccgcggctccgccggctaatagcagcagaataccggccgtgaccggcatcataccgtccgtatcaccggttttcggcagatttttgcctgtatccgggtgattggttttactattggtatcagggtgatgcccgccttgattcgtttgatgattcggtgtgtctttcccaggtgcgggattttttaatttcttattagaaacgacgacctcaacagcttttgattgtcctttttcaattgtgaattcaattggtttttcgttcagctgatagccgtcaggcgcttttgtttcgataaatcgatactgcccgggcgctaatcctttcaccgtaaaccggcccttttgatccgtcttccataccgccggccgttctttgctgccgccggtgtttaccggatgtccggcagaatccgttatcttgaattcagcaccttccagcaccttatttttatcgtcatgatccacttttgtcagtgttacatcacccggcgtcagtgtattctccgcactgatttcgactggttttatgtcggtatttgtgatcttgaatgaaattggcgtttgatccaaactgtaaagttcaggcgcttttgtttcgataaattgatattcgcctgctttcagtccccgtacaacaatctgtccgtgctcatctgtcgtcagaccttctctcagcactttgccgtttgcatctgtcagattaaacttcgcaccttgcaggactttccgtttgtcaccttgatccaattttgtaagaacaacactgttcttgatgttaactgcagtcagggcagcctgatccggttttccgctgttctcagccttaatcgtaaaccgcacaggggttgttgacagcagataaccatccggcgcttttgtttcaacaaattgatagtttccgggcgccaaaccgccggcgtcaattttgccgccttcttttgtcatcagatcttctcttacggtttttccatcactgtcaatgattttaaatactgcaccgtctaaaacgtttccgtcttgatccttcttaaccagctggacagagcctttatagttgacaaaggtgccggtctcagacggcttcggctttccttccgctgtttctgagatggtaaactcttttttctccgtatttaacacataaccgtcaggcgctttcgtttcaatgaatgcgtaatgaccgggtgcaaggccggatgtttctacttttccgtctttatctgaaaccagatcgtcctgaaccgtttttccatcacggtcgacgattttgaagactgcaccttcaaggtttcggccttccgcatcttccttcgtcagccggacagagcctttatagttgacggccgttcctgcgtcagttgactccggctttccttccgctgtttctgagatggtaaactccactttcttcgtatttaacacatagccgtcaggcgctttcgtttcgatgaaggcgtaatgacccggggcaaggccggatgtttctacttttccgtccttatctgaaaccagatcgtcctgaactatttttccatcactatcgacgattttgaaaactgcaccttcaaggtttcggccttccgcatcttccttcgtcagcaacacagagcctttatagttgacggccgttcctgcgtcagttgactccggctttccttccgctgtttctgagatggtaaactccactttctccgtatttaacacatagccgtcaggcgctttcgtttcgatgaaggcgtaatgacccggggcaaggccggatgtttctacttttccgtccttatctgaaaccagatcgtcctgaactatttttccatcactatcgacgattttgaaaactgcgccttcaaggttcccgccgtctgcatctttcttcgttaaagcggcttttcctttataattcaccattgatcccaattcaacatcaggtacttgattcttttcgttctttgcgattgagaagtgaatggcttttgtgtttacgataaaccctgatggggctttcgtctccatcagccggtagtatccggcgggcaaaccgttgatctcaactttcccatttttatcgctttcaatattattttttatcagagtataggtaccgtcgcttgattttttctcaagcttaaatacagcaccggccaaaggattattgttttcgtcttttttgataagcgtcaccttatttttttgatttatgactttatagagtgctcctgctgcggaggatttgccgtcaatcgtaacggagaccccgtttacataagcatcgctgatggtgtagccgtccggcgcttttatttctttcagtacataggttccgtaacggatattcccaaacgtaagtttaccggcatcgtctgttgtgcccgtacgcagcagctgcttgccgtctttagaccataattgaaagtctgctcctgaaagagatgttccgtctgatcctgttttagatatcgtcaggcttcccttctcccctgaccctgagccgccgccgcttgaaatagcgacaaacactgagctgttgttctcttgggtctgctcctcaacattcgtccctgatatcgacactttgttgttgacctgaccgctgctgccggaaatattaatgagagaacgatattgtatgacatacgcacggtcgatttgtttatagccgcctgtaaaggtaagggcaaatgattgttcaccggtggcattgtcagttttcatatctaatttatagtccttatctttctcaagctgcacatcacccggaataagatttccgctgctgtctttcataacgccgttctcattatattttgcttgatatactttaaaagaatcttcatctattatttgattctcatccggtgtgtctttgacttttacgtcatccagtgtcgattggctggcattgacattgatgttccaatcgatattgtttccgttctgtttgccgcctttagaaatcaggtttcctccgtttgcgacggaaactgaacccgtcagcgttcggtctgcatggtcattattaaagtactctgctttgtttgtgtattgattctgtttaatgacctggccttttaatgacgttttaaattcaatcaggtatggtacagcgtcatctgttttgagatgtacggttaacgtatttttgttgccgtctgacggctcttctatttcatattttgaaggatccagcgcctctccttcagtgatggagccgtttttgctgatggtatacgttttaacagcaaccgacccatgcaaaaattgctgaccatctgtgatcgtatcttttatataaggatgttttgaaggttcgccattgtaattgatgccgactttccatgtgatttcttttgaaacggcgttgtatgagccgtttttgaatccgttatgggacgtctgattgttcggtgtgaagccgctcgattccttatttgtgcgtttgttgccgtttttatcggtccatgtcgactccgccgtatttttaatcgtttcgtttgaaaagtcagcgttgaattttgtcttatacgtgatcttaaactgactgtttgtttctgcgtagtccccgatcaatgctattgtaaagccttgatttccgggtttttttgttaatgtataatccgttccttctttcagcgttttgttttcagtcgtgtcttgcatgttaaatgaatcgtcaatgagcgccaggcctccgctggtgaattgatcatccagcgtccagtctttcattgtgtaaccgtttttgttaactgtgattgtccaatcaaccgtcttcttctcatagtctgcgtttgaataatgtttgatcagattctgctgaatggcggttcccggagtttcctttgagtcccccgtatctgtcattgctgtattggtgtatttgacaggactgtcaataatgaccccatcgttgacttgagattgataaatgatcttatatgctcctgtgacagtttgcttgaattttatttcaaagccgttcccgttatcagtcagcgtataatcatcaccctcttttaatggggcgccctcttgttcgctgccgttctggctgaatgtaatcggaaggactttcaatgatccgggaactagatgcagatcgtctgatccgaacgtatccttaatgccggctttggattgatcaatctttttctcaccgtagttgtacataacagcccagctgaacgtttgggtttctcctttataacctgtcgaagatttttctatcatttttccgtaacccgctgttacggaagcttccgcagaaatcggctccgcattgtctccgctgaatgccgccttgtttgtcagcgtgatgtttccgcctttacccggctttgcctcatctttaatttccgtgtcatatatgagccggtaggctgaatcaattgtcccggcgaaggtgacattaccgttttcgccaacggtataacctgaagttatctcatttccctgactcaccgagccgtcaatattcacatcaagttcatacactttcacagagcggaaagtcaattcgtccggaaggctttcagtcaatttcgcatttttaacttcttcttcctttttattaaggtcaaccgtccacgttacctttccgggattaatgcctttatccaatgaccctgatttctcaatggttttattgacattcggtttaaaataaaccgttacgtccggcgtatcagagttaaccggaaacttaatcttttgtgtggttgatccttttatttctttctgattgaattgggtgtttacatacaatgaccccttgacgttagaatcttcttttacctcgccgttaaacgtcatgatgacatggccgctcgtattaatggaaaaagttccgtacgtactatcgccgtcggtcaatggctggttcgtaatgtcattatgcataataaattctttaggcaggtcaaattcatatcgatcaccgtcgtttattgttttccccagctcattcggaatcgcccattggatggtgatattcgccggagagttcgtattcgcagggttgtttttgtcatatggttttcctttttcatccgtcaatttcacatcagttaaaatattttgcgtaatccggtttccgcctgattgaaggcttttagcggcagatttgcttgtaatcaccatttttgattgactgcgtttagcagaaggttttgatttcgttgcctgttctgctttatccccgccgtctgcagatgctgattttttctctgtcttatcctgaggttcagcaggtgttgaagaggtgtttttttctgtatcggaatccgttgttccgtctttcttcacaggtattaacacttgctgggtcttgccggcatccagttgaaaaagagcttttgccattttcgtctcatctgttatgtcgggagtaaacttcgccgacagtgtaatggagcctttggcatccccggcatccgcttcagcatcgttcactttcacttccagcgtgcttctgtttgcttcagctttatatataccgatcacccgatcagctgatttcagctcaccttcggcatcattatctaatgtaaaactttccggaatctttacggtgatattccggtcacttgcatcttctttgtgttttagtgaccattcgtatgtcagtgtcactttatctcccggtgttaaagccggttcaccggcttttgatccgtcaacggtctgctgtctgccgtctttgactgcaactgaatcaaagaacccgctctcgctatgttgtgatccggaagcggctgcgatcggagtaaagctgacaacttggctgaagatgaaaaacagcgtgaagcatgaaatcaatgccgccctcagccttttgctttttttcgggctgaacgaaaagttcctcactcccaatgtcttattcctccccttttatatagacttacgttcgaacaagccggtaagcatgggattctccttatccgaaccaaactacattgtatgaaatcggcctatacaaattctgtacatgggatcatttcagaaatagcgcacaaaaaaagaccggcatcagccggtccggtcattcaatcgtcaattgattttatcttttaattgtttatatcgttcgtattcctttatcgcctcttctacctttcccagtttattaaataactgcagtttgtattgtataattttatcgtcaccgggctctattttctcaacctgcaggcaaacgtccatcgcttgacgatcgttcttctcttggatgagaaaaccaatcagttcgtacgctttgctgagccacagatgggcaagacgcgctttttccggctctgcccacagatagccattctccatgagataatggttctcatatgacatgaccatgttcatgtgccgggttagtgcagctgcgctgagcggaggagcctctttgaatgttttttcccattcaactgtatcaatctttaccccggaaagccggagaatgtatcctatatcagtattttctattgattggctgaagggcagcttaccgattaatttccgtatctgatatattgtcgagtagagctgggtgcttgcttttgatatatcataagcaggccaaaacatctccattagcatgtctttactgaccgtgcgcccttgattaagaagtaaaaatgcatacagttcacgggctttggatgttctccacttgactgttatgtatgttttgacaccatttaccgattgataaaagtccaggttcccaaaacattgtataacataatccgtcccggtattcccgtccgccgacctgagttttttattcattcggatccgctcaacagttgtcagcagccgggcattgtcaaccggttttaatagataatcgacagcattcaattcaaacgctttgatcgcgaattcattataagcggtgataaaaataacttggatattttcattgacctcctgaatcgattcagcaagctcaataccgtttatcccgggcatttcaatgtcaagaaacaccgcatcagctgctgaaagttccgaatgctccagaacttccgccggatcttgaaacgttataatagattgaaaggcgtttgtccgctcaagcatacgattaaaatgaagcaatgccagttcctcatcatccacaattaacgctttcaaaccgcatcccacccgtcaatatagatatatctgaaaataatttcaattataccatgcccaatgccctatatagttggattctttttctttctcttgttgtattataacgtttgtgattacaatatttatacattaaataggataatagaatgcccctgaatgggataaaggagtaatgatgtgaaagaaaaatttatttcgattacgattatttgcggctatgctgctttctttatgatttttatggccatggatcatttttcaggatcatccctccctcaagcggaacagggcgtgatcaatctggaaaattgggattttcaaaaggatggaaatgtccagctgaacgggaaatggattctatatccaaatcagatgctgtcaccgcaggcgcttcattcagcaaaaggaaaaaatcccgtactcgttgatgtccctgtcaatgtgaagctgttcggaaaaacggccgacgtggattacggaacgtacaaactgacaatccgatcaaatgaagacaatcaggttttggggatcagcacatcttatatctacagttcaaaccgcctttatcttaatggaaaagtaatcggacagagcggcaatccttcagaaaaagctgattttaaggcgcagaacaaaccgtacagcagctttttcaggcttcgcaagggtgacaatgaacttgtcctgcatttttcgaatttcggaaaagttcccggctgggggatcgcaaaaccgataacgtttgggactcaagaacaaattatacgcgagaatcaaatttccttttttaatgattccattatgattacggcttttttcattaccggtttatattttctcggcttttttctgcaacggacaaaggataaacatttattgttcttttccgtgatgtgtctgcttttttcagccattattcttatgatcgggaaagaaagaattatctttctcctctttccgtctatttcattttcattgctgaattccttgcgtatcatctcaaccgtgcttgtcagcatggcggtttttctttatctcttttatgcatacagagaaattgtttcaaaaacgacgatcaccattttaaccgctttatccgggatcatcttgatcactgattttatgtccggaagtttcattgatcacctctcatacattttacattctgtgctggccgttacgactctgttttatattacatatatttttacgattgccgccataagaaaaataaaaggaagcacgtaccttacactcgcatccgtctcgatgagcgcttttgtgattcttacgaccatttcagcttacagcggcaaaacagctttttcttttaattcgatctattcattgccgacagtcatcgctttattggcggtggttctcctgatggcgcagcaattcgccggagctttccgggacaatgaagtcctctcacggaaattagtcaaaatggaccaactgaaagatgaatttatcgccaaaacttcacacgaattcaagacgccgctgaacagcattattaatatatgccaaacccttgtagccggcagaaaaaagaagacgatagaggaagagaaagaaaatatgcagctgatcatccgtatgggctacagactttccgatctcgtaaatgatattcttgatttggaaaaaatgaagcaggggatgctgcagattcgtccggttcccgtcgatgtgcatgccgtcatatgcagtgagatgaacttctaccggcttttatccaaacataaaaaactcgcgattcttaatcatgtgccggacgatctccctttggtgcttgcagatgaaaaccgattccggcaaatcttaaccaatcttattgaaaatgcaatcaagtacacatccgaggggaacattattctttccgccgcaaacctgaatgacaaaatgattcaaataaccgtgaccgattccggcagcggcattcctgaggctgatcttgaaaccatttttgattcttttcagcaagcgggagggaaggaagaagatggaacgggtttaggtttaagtattgtgaaacagctcgtcaagctccaaaacggggacatctgggcggagtcagcggcggcgcaaggatcagcctttcattttacgttacccgccgctcaaattgtttctttaccggaagcaaagaccgaacttcctaaatcacagcccggacagagaataccggatatttcgttggtcacgccttatcactcagagaaaatcgatgctccgacgattctgattgtcgacgataatatcgagagtttgaaaattttaattgatatgctggaaggtgttccttataacgtaatcgcagtaaaaagcggaaaagaggcgcttcaagctgtctcttcctcgaagcttgacttggtcatattagacttgatgatgcctgacatgacgggttttgaagtctgcacaaacatccgcgaaaggttcagcatggtcgatctgccggttcttatcgttacggcagccattatcagccatgacaaatacaaggcgtttcatgccggagcaaacgacattttacaaaagccttatcattactctgaattcaccgcgcgtattaaaaatttaattttaatgaagcatacggctcaccaagccacaaatttagaaatggcatttcttcagtcgcagattaagcctcattttctttacaatgtattaaatacgattatcgcgctcagccatttggatattgaaaaagcaagggaaaccactgctgcatttacaaactatttaaggatgagttttgattttcaaaacacttcggacatcagctcattcagaaacgaactttctatcattacgtcatatctttctatagaaaaaacacgcttcggcaaacggcttgatatcctttttgatattgaacaggacattgacttcccccttccgcctttaatgatacagccattggtggaaaacgccgttcatcacgggatcagtaagaaaagaggcggcggacggataaagctgacagcgaaaaaacaaggcgaaaacacgtatcttatcaaagtggaggataatggaaccggcatcatgccggacatacagaaagatattttgtcttctgatgttaatcgcagtgtcggcctgaaaaatatcaatcggcggctgaagcatttttgcggaagcgaattgacgatcaccagcaccccggatgagggcaccgctgtttcgatgatgattcacactcccggcacaacggatgattcgaactcactgaaaacgtcttcattaagatactgattaacttcaaaaggcatgtaaatacttctgccgactgtcgggaaattcccgtcagcctttacagaaagacgtaaaaacaaaaaagcttgaagaaaaaatgatatcttctccaagcttagcttagatgatccgcaccagtctggccgttctcacttaagaaatcgtaacccccgcgcttgcatatcccgccactgtattaataagcgaaaggcctgtcgcagtggcagagaataccattaacagccgggtttgaggagttaccgcaatgttcagccctgtcgtgattccgttgctgatgctgccgattgacaatacgccggtgaggggaggagctaaagtgacggatgctccggggatcggcgtgaacgtattgttcggcacagtagaactgtatagttgtgcggttatcgtaacagtcgagccgacaagcgacaatgctgcggttgtactgaaataggcggcaattgatgtaatggttccgcttctcggagcagaaaaagcaaagttcagcagagttcctccagccccggtaagatcaattgcacctccccctccgacattgacgcccgtcacagaattgccgaacccgacaaggctcaccgttccgattaatccgccggcaatggtcgtcacggcagtgggaagacctgaagcgtaaggaatgatcgcgcctgctccggtgatcccggtggcgcctgttgctccagtagcgcctgttactccggttactccggtgatcccggtggcgcctgttgctccagtagccccggttgctccggttgctcccgttactccggtcgatccggttaccccagttactccagtcgctccggtgatcccagttactccagtcgctccggtgatcccagttgcacctgttattcctgtcgctcctgttactccggtagcgcctgttaccccggtagctcccgttattcctgtcgctcctgttactcccgttactcccgttactcctgttactcctgttactcccgttactccggtcgatccggttaccccagttactccagtcgctccggtgatcccagtggctcctgtagcgccagtatccccggttactccggttgcgcctgttactccggtcactccggttaccccagttactccagtagccccggttgcccccgttactccagtcgctccggttgcccccgttactccagtcgctccggttaccccggtggctcccgttactcctgtcgctcctgttatcccagtggctccagttatcccagtggctccagtagccccggtggctcctgttactccggttaccccagttactccggtagctccggtgatcccagtggctcccgttactccaatcgctccggttacgcctgttaccccggtggctcctgttattcctgtcgctcccgttactccggtcgtgcccgttatcccggtagctccagtatccccggttactccagtggctcccgttactccaatcgctccggttacgcctgttaccccggtggctcctgttattcctgtcgctcccgttactcctgtcgctccggttaccccggtagcgcctgttatcccggtggctcccgttactcccgtggcgccgggatctccagtgactccagtggcaccggttaccccagtcgctccggtattcccggtcgagcccgttgctccggtcagtcctgttgctccagtgaaccccgttgctccagtcagccctgttgctccagtgaaccccgttgctccagtcagccctgttgctccagtgaaccccgttgctccagtcagccctgttgctccggtcagtcctgttgctccggtcagtcctgttgctccggtcagtcctgttgctccggtgcaccccgttgctccggtgaatcctcttacgtgaaaatgatttggatgacagcatggacaccatctttcatgacagcaagggggttcgcaacagaatccttcacagcaatgtgcccgattttgataactgcgcctttgatttcttcttttatgttgaaaatgacagcaacactcattacaatttcggcagtcgtaatcccaagaatcgtatctgttataccaagtatctccttttctcattacaccacctctattttcataatatttccacagagaaaaaaggtgtggcaaaaccccacttctattgggcaatttttcaaatgttcgttaagactgcatcatgcacagcattttacagaaaaaagacctaactgtgcataagtcaggtctttcatctttaaaatatcagtctgctgttgtattaggttgtcggaaaacttatgctgttaaaatcgatattgagtgcagttgctgtcgttaaattattagcagttgtgaaaataaccctgagctggtaagtgttcgttcctgcggtcggcgcagtatccactgttgtatcagcaatcgaaaaactatccgtagctgcgagagtactggttcgcgacagagttcttgtatgaatttgcactgctcccctatataatctcacttcaaaaacaaagtttgaattcgctgcagttgttaacgcggcactgagtgcataatccagctttacattctgcaaagcattaactgggattgccagcgtagcaacgggaacttctgtatttaacggcggataaacagtgagcggcccgttggttcttgtgaagagcaaggttggtgtactgcctgtggcgccggttggtccggttgggcccgttactccagttgggccagtcaccccggttactccggttgatcccgttactcctgttactcccgttgctcctgttactccggttgctcccgttactcccgttactccggttgctcctgttactcccgttactccggttgctcctgttactcccgttgctccagttgctccagttgctcctgtcacacccgttgctccagtcacacccgttggaccggttgggcctgttactccggttgcacccgttactcctgttactccagttactcctgttactccagttgctccagtggctcctgttgctccagtcacacccgttgctccagttacacccgttgctccagttacacccgttgctccagttacacccgttgctccagttacacccgttgctccagttacacccgttgctccagttacacccgttgctccagttacacccgttgctccagttacacccgttgctccagttacacccgttgctccagttacacccgttgctccagttacacccgttgctccagtcacacccgttggaccggttgggcctgttactcccgttgctccagttagtcctgttacacctgttggacccgtttctccggttgaacctgttactcctgttgcgccagtcgctccggttatccccgttgccccagtcactccagtggctcctgttgatcccgttactcctgtggctcctgttggacccgtgattcctgttgggccagtttctccagtggcccctgttactcctgttggacccgtttctccggttgaacctgttactcctgttgcgccagtcgctccggttatccccgttgccccagtcactccagtggctcctgttgatcccgttactcctgtggctccagtcacacccgttgctccagtcacacccgttgaaccggtttctccggttgagccagtaacccctgttgatccagtcacaccggttacaccagttgagcccgttgctccggtttctcctgttggtccagtcacaccggttgggcccgtcgcgcctgttgctccggttatccccgttgctccagtcactcctgttgcaccggtttctcccgttgtcccagttaccccggttggaccggtcgctccagttacccccgttgccccagttgctccggttgggccagttgctccggttgggccagtcgctccggtttctcctgtcgcccctgttactcctgtcgcccctgttactccggttgagcctgttgatccggttacaccagttaccccagtcgatcctgttgctcctgtggctccagtcacacccgttgaaccggtttctcctgttggtccagtcacaccggttgggcccgtcgcgcctgttgctcctgttatccccgttgctccagtcactccagttgcaccggtttctcccgttgtcccagttactccggttgatcccgtggttccggtttctcctgttacacctgttgggcctgttactcccgtcgctcctgtttcaccagttgggccggttgagccagttacaccggttattcctgttgaccctgttacaccggtcgctccggtttctcctattgaaccagttgatccggttgctccagttactcccgttgaaccagttgatccggttggaccggtcgctccagttacccccgttgccccagttgctcctgtcactcccgttgaaccagttgctcctgtcactcccgttgaaccagttgctcctgtcactcccgttgaaccagttgagcctgttgctccggttacaccagttaccccagtcgatcctgttgctccggtttctccagttattcccgttgcgccggtcgccccggatgcacccgttgcgccagttgagccggtttctcccgttgctccagtcacacccgttggaccggttgcgccagtcgatccagttgcaccggtttctcctgttgagccagtcgcgccagttggacccgttactccggttgcgccggttgagccagtcgcgccagttggacccgttactccggttgcgccggttgagccagttgagccagttgagccagttgagccagttgcaccggttgagccagttggtccgatttctccagttacccccgttgcccctgttgcgccggtttctcctgtcgctcctgttactccagttgagcccgtggttccggttgctcctgttgatcctgttaaacctgttggccctgttgcgccggttgggcctgtcgatcctgtggcgcctgtttctccagttaatcccgtcgcaccagttgagccggttactcccgttaccccagtcgctcctgtcgatcccgttacaccagttagacccgttactccggtggggccggttgctcccgttaccccagtcgctcctgtcgatcccgttacaccagttagacccgttactccggtggggccggttgctcccgttaccccagtcgctcctgtcgatcccgttacaccagttagacccgttactccggtggctcctgttgctccagtcactccggttggtcccgttgctcctgttaaaccagttgaacctgttcccccggttgcgcctgtttctccagttattcccgtcgcaccagttgagccggttgagccggctgctcctgtcggtccggttgggcccgttcccccggttacacccgttaccccagtcgctccggttatccccgttgtcccagtcactcctgttggacccgttacacccgttaggcctgttgtacctgttactccagttgacccggttgctcctgttgatcccgttactccggttgcacctgttgctccggttgggccagttgatccggttgctccggtttctccagttattcccgttgcaccggttgagccggtttctcccgttgagccagtcggtccggttattcctgttgacccagttacaccggtcgctccagttactccagttgagcccgtggctccggtttctcctgttgagccagtaacccctgttggtccagtcacaccggttgggctcgtcgcacctgttgctcctgttatccccgttgctccagtcactccagttgcaccggtttctcccgttgtcccagttactccggtttctcctgttacacctgttgggccggttggaccggttggaccggtcgatccggttattccagttgaaccagttactcccgtggctccggttggtcccgtttctcccgttgcaccggttactcctgttgtcccagttaccccagtcgctcctgtcgatcccgttgcaccggttgaacctgttactcctgttgatccggttactcccgtcaccccggttgttcctgttgaaccagtttctccggttgaacccgttgctccgattggaccggtctctccagttacccccgttgcccctgttgggccggttactccagtagctccggtatccccggtcgagccagtttccccggttgctccagttactccagttgcaccggtttctcccgttggacctgttactccggttgagccggttatccccgtcgcaccggtggctcctgttgctccagtcactccggttggtcccgttgctcctgttaaaccagttgaacctgttcccccggttgcgcctgtttctccagttattcccgtcgcaccagttgagccggttgagccggctgctcctgtcggtccggttgggcccgttcccccagttacacccgttgcccctgttgcgccggttgggccgcttggtccggttgggccggtcgatcccgttacccctgttactccggtcgctcctgttactcccgttacaccggttgggccggttgagccagttactcctgttgggccagtttctcccgttgcaccggttgatcctgttactcccgttacacccgtttcaccagttgggcctgttacccccgttgctccggttgggccggttgttcccgttcccccggttataccagttaccccagtcgctcccgttgcaccggtttctccggttgagcctggcgatccagttggaccgatctctcccgtgggtccagttgatcctgctgcaccagtaactccagttgaacctgtcgacccggttggaccggttggaccggttgatcccgttgctcctgttactcccgttgctcctgttgaaccagttgaacctgttcccccggttgcgccggtttctcctgtcggtccggttgggcccgttcccccagttacacccgttgcccctgttactccggtcgctcctgttactcccgttacaccggttgggccggttgagccagttactcctgttgggccagtttctcccgttgcaccggttgatcctgttactcctgttgatccggttactcccgtcgccccggtttctccggttgaaccagttgggcctgttacaccagtcgctccggtttctcctgttgcaccagttactccagtagctccagttactccagtagctccagtatccccggtcgagccagttgggccggtttctcctgtcgaccctgttcccccggttggacctgtcgaccctgttcccccggttggacctgtcgaccctgttcccccggttggacctgtcgaccctgttcccccggttggacctgttattccggttgggccggttgggccggttgatcccgttgctcctgttactccagttgagcctgatgagccagtcgcgcctgtttctcctgttactcccgttgcaccggttgcaccggtttctcccgttgagcccgtcggtccggttgaacccgttgcccctgttattccggttgaacctgtagatccagttggaccggtctctccagttgcgccgatttctccagttacacccattgcccctgttgggccggttgggccggttgagcctgtagatcccgttacccctgttactccggtcgctcccgttacacccgttgcccctgttgggccggttactccagtagctcccgttgcaccggtttctccggttgagcctggcgatcccgttggaccgatctctcccgtgggtccagttgatcctgctgcaccagtaactccagttgaacctgtcgaccctgttggcccggttggaccggttgatcccgttgctcctgttgaaccagttgaacctgttcccccggttgcgccggtttctccagttaatcccgtcgcaccagttgagccggttgatcctgtcggtccggttggtcccgttaccccggtcgatccggttatccccgttgtcccagttactcctgttggacccgttacacccgttaggcctgttgtacctgttactccagttgacccggttgctcctgttgatcccgttactccggttgggccggttgctcctgttgagccagtcgcgcctgttgatccggttgaacctgtcactcccgttgaaccagttgagcctgttgatccggttacaccagttaacccagtcgatcctgttgctccggtttctcccgttgtcccagttactccagttgggcccgtttctcccgttgatcctgttactccagttgatcccgttgcgccagtcgatccggttactcccgtcgctccagtttctcctgttgaaccagttacaccagttgcaccggtttctcctgttgaaccagttacaccagttgagccggtttctccggttgagcctgttgcaccagtcactcctgttgggccagtttctccggttgcgccagtaactcctattggaccggttgagccggttggaccggttgagccagtcgcgcctgtttcccccgttggacctgttactccggttgagccggttatccccgtcgccccggttgctcctgtcgatcccgtgaccccgatcgggccagtcacaccagtttctccggttgaacctgttggtcccgttcccccagttacacccgttgcccctgttgggccggttgggccggttgggcctgtcgatcccgttacccctgttactccggtcgctcctgttactcccgttacaccggttgagccagttactcctgttgaaccagtttctcccgttgcaccggttgatcctgttaccccagtcgagcctgtcgatcccgttgcaccggttaatcctgttactcctgttgatccggttactcccgtcgccccggtttctccggtttcaccagttgggccggttgttcccgttatgccagtcgagcctgttgctcctgttactccagttggaccggttgttcctgttgggcctgttgctccagttactcccgttgaaccagttgctccggttggaccggtttctcctgtcgcccctgttactccggttgggccggtttctcctgtcgatccagttggacctgttataccggtcgcgccggttatccccgttgctccggatgggcctgttgctcctgttatccccgttgctccagttgggccggttgttcccgttcccccagttacacccgttaccccagtcgctccggttgaaccggttgaaccagttgctcccgttactccagtcactccggttgagcccgtggttccggtcgctcctgttacaccagtcgagccggttgctccagttactcctgtcggaccagttactccgtttggaccggttacacccgtcgctcctcttgccccggttgcaccagttactcccgtcgctcctcttgcgccggtcactcctgttgggcccgtcactccagtgggacctgtaattcctgttacgccaggttcacccccggtttgcgccaatgaaacatcgtctattaaaaccgtgccggaagaaactttacttaatacaatgacggcagaggccgcgccagaaggcacactgcttgttttatagatttcagaccatgtgtgaaagagcacgttcggcaaatttccgggtgtaatattttcttgaatggaactgatttgttcacctgctgcgctgacatagatgatctggagagtgacttggggacttggatcatttccgagcgttgcgagtgatacgaatagagtcactgacttggctgaaatgggaacgatttgactgaggtaagcatatggctgagctccaataaattgcgcagaatatctccctgaatgtgcaaacaaactgttaatctgggtatttgccgaactccaccccgctaatgtgccggtttcaaagcttccgtttataatcggattattcattcaatctttttccctctccttcccgttgttgaccgtcttacttattaagacagcatattaatacgggctgtgttttgacaacctaaataaaaaaggtgatttcttttcatcaccttaatccgatccttgaatggggaatcccgtcgcaatgagggagcggtttgctgctgcgacttgtgttacgtagttcgaagaaaggacggataaatagagctgatacgcggctgtttcatccgccttcatttcgtcgatgtacgtaaaaggaattcctatgatttgtccgcctgaagaaaagaggttccgctcttgtctctgtgtttgtatcgttacgccatttctttgcagctcgacagctaagaccaatgagaaatgagacgcaagcggatctaattccacatttacttgtatgacggcatccgttttcaccaattgatctgtcggcgcagctatcactgcgcttaacacgtttatcggtgttccttctaacggaagcgtcattaggtctgctgtattttgaaaagctaccgcaggaaccgctcccggcggcccctcaggccccgggggaccgggcggaccgggcggacccggcggacccgcctccccttgcggaccgcgggagccggcgggtcctcttttgccttcgggacctcgcagcccgggtacgcacaaggcagatcgattttcatttgaagacggaaaccgtttttccgtccctgtttccggactttcaagttcacatggtaattgttcataccggcgtttcatatgtctgctcatatatttgtaaggtttctgtttcaatatcatgtattgattacggccgctgctcataatatcaccccggcaatattctattcgcactgaagtcagcgtgtgcaggcccttcccattccttacagaaataaaaaaaaggcagacctgagtctgccttttttcttctaccataaccctaatactttccaccataatccgccgatcacaagccatgtcacaatatggacgattgacaggataaagccgatggaccaccatttgctttgcgagatataacccgctccgaaaaagaccggagccgctcctgagccgtaatgcgtcgtcgaaccgaaaaggttgctgaaaaacgccaggctgagcgccgccaacagcggcggagcgcctgccgccacgatgacggcgagaaatgccgcatacatggcgctgatatgcgcggttgcgctcgcaaagaagtaatgcgtgtaataatacacgacaatcagaatcataaatgccacaatccatgaaaaaccggaaacagatgatttcatcatattgctgaaccaagacaccatgccgagctcattcaggaaattcgccagcatcacaagcgccgcgaaccaagtcagcgtatcccatgcaccttgttcttttttgatgtcctcccatgttaatacctgtgacaaaagcaaaacggataatccgatcagggccgtcgtcgttgcgtcgatatttaagcttcctccgaaaatccacagcgcaagcaccaataaaaagacgataaccatggagagttcggattttttaaacggacccatttctttcaatttttccgttgcgattttagccgcgtccggtgtttctttaatttccggcggatacagcttataaatgacgagcggcgtaatgattaagctcgccaatcccggtacaatggccgcgattgcccagcttgtccatgtgatgtccacccctgcgacatcgtgggccagcttggcgatcagcggattcgccgccattgccgtcaaaaacatcgcagacgtaatcaagtttccttgaaaaccggtttttaataagaaagcgccgattttccgctctgttccgtctgccggcgttgatccgaaagtttcggataatgatctgataataggaaaaataatgccgcccgcccgtgccgtgttgctcggaatggcaggtgataaaattaaatcactgaacagcagtgaataagaaaggccgagtgttttcttcccgaaccgttgtacgaatacgtaagaaatcctggcgccaagcccggttttgataaatccccgggaaataaaaaaggcgatgacaatcagccagattgtcttgtttccaaatccgcttaacgtattttcaatagatagcgttcccgttaacgcggtgactgccaatgcaaaaattgcaattgcgcccattggcaagggcttggagataaagccgataattgttgcgacaaaaatagcgaacaaatgccatgctttaggttcaagtccggacggcgcgggaataaaccaaatgattaatcccacagcaacagtaataagcaaaggaatgatttttactgcctgctgtttttttgcgtctttttctgaagccattacaggtctcctcctattttgttgtcttccatccccctatcccattttactacttaactaagttaataaacgtttttgttaattaaaaaacacaaaggaatattttcctttgtgcttcttgtttattattttaatatacccgacccggctttagatataacatctgattttacatttgatgatgagccgatggaaccgtgcaatgacggtgtccagccgacggactgacttaatccgttggcagctgacgcgttaattgcggcgccgtttaaaagagtgccgtcttcatgaagtgcttttccgccgctgaagacgctgatgactttatcagcagccagtcccggcacttcaaagacattattctgggcatatatttttgacgcgtggcctgcgccccacgcatagctgaacgggtatgcggcgcttttagagcctgcgtaaaaattattataaatatgaacctgcccgtaccggacccgcggtgcgcgctggacgatgttctggtaatagttatggtgaatggtcaccttcagttttccttcatccgacgtcttgctgtcgctgtttccgatgacggagcctttgtcatggtcatgatatttattataggacaatgtaatataattcgccccgttggctatatccgtctggccgtcatggtgctgatattttctcccgtaatagtagggaaaaccgctgtcgggattcgatccgtcattaaaggtgcaatgatcgatccagatatgcgtcgcgccgttaatggtgatattgtcatattccgagttccagttgccgctgctgccgtccgtcgggtcccattgcggaaaatagtcgtaagcgtcttgaaattcaatgttgcggatgatgacattgtcgacgccgttctttatattaaaacttccgcctgtcactttggcatttgaacccgaaccgatgatcgtcgtatttgaaggaatgtcaatcacgacccgtgctttctggtttttttgagatcgctgtctggcgtcttcctgggtgcctgacggcgcttttttcccccatttgtccgggtcgtacgccttcagataagcgttgagatcatatgccggatctttataatcattaaagccgagcgttttattccggtcgtccgtattcatattgattgtgccttgtatgtaaataatcttcggcgtgctgttggcgcttccccctaatgcagaaacgagctgctgtctgtttgatacggtgtagacattcgataaagaggctttcgcgccgccggttgtcccgccggaagcggctccccagccgtcatttgttcctaacgtctgccgtcccaggtcagcggcatagacgtccgcagggatcatacataaacaaaccgccagcataagtaacatttttttcatgaattgtgctcctcctgattctctgttccaatttattacaattggattgtatcaaatcagttgagaaacggcaccgaaaatgtacagcatgtgcctttcggttttattgcggaaaccgcaaaaaaatcccaagggaccgaaaaccccttgggatctgttcagcttacgcccatgattttactttttcgttatccgtgacaaacagaagaacttttccttcatctaagcgcttttcaaattgtgatgcttcctcttctgaaaagccgatttcgtgaattttgttgcggagctcgtcgccttttttattaaacatattgccgaccgcgtgtttaatgcccgtttctttcgctccgatggtattgacatcagtattatccgccagacggtccgttctgtcgtcatcatgtgaaagcacatatacgtcttcttttgcgacacccaattgctgaagctcttttacgtcctgcatcagtttttgatcatttgtatattctcttactaccggtttcattgataagtcctcccttttgtttttgtatattggatgtttacccgctcaaccaaaggtcaaacaaaagaaagagagttccgggaaaaaacgggcagattgtcggtggatattttccggcgggacatgttacagtagggaaagtaacttttatcagaaaaataaaaatcttcatgagccgattaagcagggaggtggttcctattcattacttttcaccggaacagcgatttaacgcttgggttgtcagtgatttagtgaagcaggtattccgccggcatacccgctgcccggatggaataaaagagcttacggcctttgctgaagatacttttcatattaatatcgatttcgttttctctatcattatcaatatcggtgatatcgaatccgttctgccgacagaaattgaaaataagctgggttcttatctgaccgcgcttcagcccgtgattacctctgacatgcttcattcttcaaaaacgaatgcctatgaatatttggaacatgagaaaaacaccgatgtgtaccggttattcttttaaatacgcatataagaaaagaagggccctggcccttctttttttgttgccggcggacggtttgattttgtattcgggaaatggttcgtgttacatttggaacaaccacttatcttgaaggaggattcagtatgccgaataatcagcagcagattcaattggcaagacgcccgaaaggcgttcccgtccatgacgatttccgctttgaaacgattgccgttcccgaaccgaaagacggcgaagtgcttgtgaaaacgagttatgtgtccgttgatccgtacatgcgcggacggatgcaggatacaaaatcatatgtagagccgttcgctttagatgaagccataacaggcggagtgattgccgaagttctgacagacggcgataagctgaaaaaaggagatgttgtgatcggaaatctcgcatggcaggaatattcagccgtcaatgagtccgccctccgcaagttggatacggatatcgcacccgcccaggcgtatctcggcattttagggatgaccggactgaccgcttacttcggcctgcttgatatcgggcgtccgaaaaaaggcgaaaccgtcgtcgtttcaggggctgcaggcgccgtcggctcaacggtcgggcagattgccaaaatcaaaggcgcgcgggttgtcggcatcgccggttctgacgaaaaaatcgcgtatcttaaagaggagcttcaatttgatgaagccattaattacaaaacggcggatgatattcaaaaagcgcttgaacaggcatgccctgacggcgtcgatgtctattttgacaatgtcggcggaccgatttcagatgcggtgataaacctgctgaatgaattcgcccgcattccggtatgcggagcgatctcttcatataataccgaaagtgaagaggaagacatgggcccccgcgtccagccgaagctgatcaaaacaaaagcgctgatgcaggggttcatcgtcagtgattatgctgaccgcttttccgaaggcgcgaaacaattggccgaatggctcaaggacgggaagcttcattatgaagaaacgattacggaaggattcagccatattcctgacgcgttcctcggtttgtttaaaggagaaaacaaaggcaaacagatcatcaaagtcagtgatctaggttaacatgatgatgaaaaaaggagggctttgtcccctccttttctgctttttcgcatcagccgcgaagaatcaaagtaagaaagccgtcttcatcaggctccgtattttccaaagtgaatcccgctgcttgaaagcagactaaactgatttgattgtctttttagatgcttgccgcccattcccgcacgccggtaaacccaggatcagtcagcagtttttgcaagatctgttttccgtacccttgaagctggtacaaaggattgacgatcaatccgatatacgcccgttcctccacaaactctatagagaccattcctgccggaagctgcccgtcatatgccataatgacagtatcgtcttcatctttactcaatcgtgcataccatgcatttagtggccgcatcgcatccattctccgtctgatattatcgttcttaaaccagtgttcaagtattttcagctcacgtaccttcaatatttgaaatcggtctattgaaaccatcttcccgcccccgcctgaaccttttctattatttcacaataaaaaagaagggcttcccgccctccgtttcttatttctcagataattttccgcctgaataaacggcctctttcagctcaattccgagtgatttggccatttttttcaatttggattcttccatcggcgtgacaaggctgagtacggttccttctttaccggcccgccccgtccggccggatctgtggatatatccgtcttcattcgggatgtctgcgtgaatgacgtacggaagatcatcgatatcaagtccgcgcgccgctatgtcagtcgccagaagcagcggaaattctcccccttcaaacgctgataatatctttgcccgctccatttttttcgcttctccgtgcaggatgccgagatccacgtgatgataggcgagtttttccgcatagacgcttaaatttccgatatctctgacaaacacgagcgcctgcatgccgttcagccgtgacagcttttgcaatagcttcactttatcccgctgatcgcagacgagatattgatgcgtgacgcgcgctttttccgccgtattccgcgccactttcaaaacggccggttcatgtgcgatggcattcagcacctcttctgtctccggctgcagcgtagcggaaaagcttaaaagctgtcggtctttcagcgtcgttttaatgatttttttcatcgtttcgcggtgttcctttgtcacgagctgatccgcttcatcaagaacgatcgtcttgacttcatgcattttcagctttttcgcctgaatcaattcgagcaccctgcccggtgtgcctgcaatgatatgcggtttatttttgagcttctccacctgctttttcacgtttgccccgccgatcaaagacaaagcgcgaagatcggagccttttttccactcctgaatcacttgaaaaatctgcatcacaagctcgcgggacggcgctaaaatgatcacttgcggatgtttctgttccgggttgatccgctccagaaccggaagcgtgtacgccaatgtttttcccgttcccgtcggggattcggcaatgacgtctttcccttccatgatcacctgagcggctttttcctgaataacggtcggctcctgaaagcctgacgcctcccagttttcggcgataaatggttgtgtatgctgtaaaaatggccatgtttgggtcatgtcgttctcctcaattcttaaaatctactccatagtatctcaaatgcacgcggcaaacgcaattttctttttccttccaagccttttaacaaacggtctcctcctttataatcataaatgagaaagacacatgataaaaaaagcgtgtctgataacgatagaggtgtaatgatgagtattttatccgtaaaagatttaagccacggcttcggtgaccgtgcgctttttaacaatgtatcgttccgtcttttaaaaggggaacacgtcggcttaatcggagcaaacggcgaaggtaaatcaacgtttatgaatattattaccggaaagcttgagcctgatgagggtaaggttgaatgggcgaaaaacgtgcgtgtcggctatctcgatcagcataccgtgcttgaaaaaggaaaaacgatccgcgacgtgctgaaggatgcgttccattacttatttgcgatggaagaagaaatgaacgagatttacaacaaaatgggcgaagcggaccctgatgagcttgagcagctgcttgaagatgtcggtgtcattcaggacgccctgacaaacaatgatttctacgtgattgacagcaaagttgaagaaatcgcccgcggcctcggcctgcaggaagtcggcctagaccgcgacgtcactgacttaagcggcggacagcggacgaaagtgctgctcgccaaactgcttttggaaaagccggaaattcttctgttggacgaaccgacgaactaccttgatgaacagcatattgaatggctgaaacgctatttgcaggaatatgaaaatgcgttcatcttaatttctcacgacattccgtttttaaacagcgtaatcaatttgatttatcatgtggaaaaccaagagctgacgcgttatgtcggtgattatcatcagtttatggaagtctacgaagtgaaaaaacagcagctcgaagccgcctacaaaaaacagcagcaggaagtggctgagctgaaagatttcgtcgcccgcaacaaagcccgcgtcagcacgagaaatatggcgatgtcccgtcagaaaaagcttgataagatggatatgatcgaactggcggccgaaaaaccgaaaccggaattccatttcaagcctgcgagaacgtcaggcaagctcatttttgaaacgaaggacttagtcatcggttacgatactccgctgtcacgcccgctcaatctcagaatggagcgcggacagaaagtcgccctgtacggcgcaaacggcatcgggaaaacgacgctgttaaaaagcctgctcggtgaaatccagccgctggaaggcacggtggagcgcggcgagcatcaatacacgggctatttcgagcaggaagtgaaagaaaccaataacaatacgtgcatcgaagaagtgtggagcgaatttccttcctttacccaatacgaaatccgcgccgccctcgccaaatgcggcctgacgaccaaacacattgaaagccgcgtctccgttctcagcggaggagaaaaagcgaaggtcagactgtgcaagctgatcaattcagaaacaaacctgctcgtgcttgacgaaccgacaaaccacctggatgtcgatgcgaaagaagagctgaaacgcgcgctgaaagaatacaaaggctccattctgctgatttcccacgaacccgagttctacatggatatcgcgacggaaacatggaattgtgaatcttggacgacgaaagtgctgtaaacacaaaaaggaactcccgcccgtgcggaagttcctttttttaatgtccggcttttattccggcaagatgtttgcgtcccataagaagaacaagcatgccgacaaaaacgacaatcccgcctactgtatatggtgtgcttgcggtgaagtgttctgacagcattcccgcaatccacggagcgagcgcaccgccgataaagcggactgagctgtaggctgaagacgcgatggaacgttcaaccggcgcagcacccatcacagcggttgtcatgatcgtattcaccataccgaggacagcaccggcaacaacgatacatgtaatgatcaacgtctgatggtcagtccagacccccataataacgagaatggccgcaaaggcgataaagagaacgacgagcgaacgcactgtgcccagcgctttatgcacgagcggcgccgtaaagactgacgtaattgccagcagaaggccccagccgaagaagacgtatccgagaccgtgttcatctaaatccagaacgaacggagaataagcaagcaaaataaaaaatccaaagttgtataagaatgcagatactgccattgtcaaaaggcctttatatttgagcgccttcatcgcatcaaacacaccgacgcgtttcgccggtttcggcagcttcggcagcatgagtgaaatcgcgcaaagcgctataaacatcaggacagacactccgaagaacggagcgcgccatgaaaggctgcctagctctccgccggcaagcggcccgacagaaattcccagtccgagcgcggcctcatacagaataatagctttggcgctgccgccgacagatacaccgacgatgacggcaagcgcggttgaaataaagagagcattcccaagtccccagccgccgcgatagccgacaagctgagcgattgaacttgagcttccgccgagagcggcaaacacgatgataaaaataagtccgagaagcagcgtccattttgcgccgatccggcttgaaatcgcgccggagaaaaacatcataaaaccggtaacgagcaaataacttgtaaataacagagatacttcactaggtgaagcatgtaattgtgcggcgattgccggaagaattggatcgacaagaccgattcccataaaggaaatcacacaggcaaacgcaaccgcccaaacggctttcggctggctgaataagcctgttttctgttgtgatgatgtatccatttgaccagacctcctgttttatccattaaaagaaacgctatatccatagcgtttacagcaaaatcattcgattgattgaatggcgcggtcagctttttctttcattccgttaaggcgcgttttaaaatgctgaaatgtgctgatcttctcatcaatcatctcaagctggtggttcaaagcgtgctgaatctcttccagcttttctttccgttccttcggatccagtgacaacaagtacccctctttgtttaattccagctgacggctcatctccataaactgctgaagttcctgaagggaaaaaccgagcacttcttttgtgctggtgactttttcgagctcctccatatcatcttcagagtaaagccggacgccgccttctgtccgtttaggagcaggaatcaaaccaatctcctcgtaaaaacgaatggttcgttttgtcaatccgcttcgcttggcaacttgatcaatcttcatccattccaaggtgaatccccctcttgtcgtatctgtttctattatacaccatttgaaccttaacgtaaacgtaaactttttatgccggataaacttggcttggacggaacctttgtctttaaagcgccgggagacatctgtgtaagataaaaaaagccggtatgacccgccatcttctcgggggccgtaccggcttttcttaattctcaagttcttcaatcatcagtgacaattcggtccagcgttccatcgccgcttcaagctcttcagccgtttttgcctgttcggccatcagttcttgtatctttccgaaatcacttcccgcttcagcgatttccgcttccagacgctgatgcttttcttcaaggccggcgattttgtcttcgatgccgtcccattcgatctgatccttgtacgaaagctttttgcgctttttcttcggctcttcttccgcctttttctcttcggccggctgttttaccgccgtcttcttctcttttgcttgttccatgtattcactgtatgaaccttggaaacgggaaatgacaccgtgtccttcaaatacgatcaggcggtccacgacgcggtcaaggaaatagcggtcatgggatacggtgatgacgacgcccgggaactgttcgatataatcctcgagcacgcttaatgtttctgtgtccagatcattggtcggttcatctaaaaacagcacattcggctcctgcatcagtacattcagcaagtacagacggcgtttttccccgcctgacagctttctgatatatgtctgctgcatcggacgcgggaacagaaaacgctcaagcatttgttccgcggtgatgacatcgccttccgccgttttgacgatttcggccgtctcttttatatattcaatgactttcatatcgccgttcatttcgctgtgatcctgggtgtagtagccgatccggaccgtctgcccgatggtgatattgccgctgtcaggctgaattctgccggcgaggctgtttaaaagtgtcgttttcccgattccgttcggcccgatgatgccgattcgttccccagggatgacaagctcattaaactggctgatcagcgcttggccgttataggtaatggagacgttatcggcttcgattacttgttttccgagacggtgggaaccgatcgcgaaatcgagtgatccggagactgccggccctttttgctccttgagcgcctccgctctgtccactctcgctttttgtttcgtcgagcgcgctttcgctcctcttctgagccacgccaattcgcggcgcaggaggttttggcgttttgtttctttctgctctgccagcgcctcccgttcggcccgtttttccaggaatacttcatagtttcctttatacgtataaaggctgcctctctcaagctcgtaaattctgttcgtcaccctgttcagaaaatatctgtcgtgcgtgacaagcataacggcgcccggatattgcgataagtagccttccagccattcaatcgtttcattgtccaagtggtttgtcggttcatccaaaatgagcaggtcagccggctggatgacgtttttcgcaatcgcgacgcgctttctctggccgccggacagctcgctgacatccttcatcagatcggtgacgccaagtttggttaaaaccgttttggctaacgtattcgcctcccacgcatcattcgcgtccattcgggcctgcgcatcaagcaggtgtttctgacgctggtcattttccggttcttcattcagcgcctgaagcgctttttcgtactctctcatcgttctcatgacggctgatccgccggaataaatatgttcaagaacggtttgtccggccggaagctcagggtcctgatgcaagaactcaatatgcacgtttcctgaagccgtaatctcgccttcctccgttgattcaaggccggcaatggttttcagaagcgtagacttccccgttccgttcgggccgattaaaccgattctttcattctcttcaatatgaaaggagatatggtcgaataatgtcttatctccgtatgttttataaaggttttccgcttttatgatgctcatggttcctatcaatcctcacgtaagttcatgtgttcattttaaatcaggcgctgtaataaaactagtaaaaggacagacaaatttcttggaagagatcattttgtccgaagaatgtttccgcctctccttttatacactggaggggaagaggtgatgacatgatcagcgtcagtttgtgcgttatcgtgaaaaatgaagaggaagtgcttgcgggctgtcttgattccgtcaaagacattgcggatgaaattgtgattgctgatacgggctcgaccgaccggacgaaagaaatcgcggcccgttatacggataagatttatgattttgaatggatcgatcactttgccgccgcccgtaattttgtgttttcgaaagcggaaatggattatattctgtggctggacgccgacgatatgctgacggtaaaggaccgtgaaaagctgattgaactgaaggcgtcgctttcaaaagaggtggacgcggtatccatgtattatcacgtcggctttgatgatcggggagaggtcagcttcagataccgccgcaaccgactcgtcaagcgtgaaaaagggttccgctggatcggagccgtgcatgagtatcttgaggtatacggaaacatcatagaaaccgatattgccgtcacacaccggaaatccgaaaaaaagcactcgcctccctcggaccgcaacttgaagatttatgagagaatggcggaaaacagtgaatcgatgacaccgcgcgatttgttttacttcgcgaatgaattaaaggatcacggccagtatcagcgcgccatcacgtattatcaccattttctttccacaaaacagtgctggatcgaagacgagatcagaacgtgccaatatctatccgattgctacagggcggtcggccatgaagaggccgccatgacgtctctcttaaaatcatttctgatcgattgtccgcggccggagttctgctgcaggctcggcgactattttgcggagaaacggcaataccggcagggcgtgttttggtatgagctcgccctatccgccaaaagcagtgatgcaggctttacccagctcgaatattccacctggtacccccatctgcagctctgcgtctgccactggcagctcggcgacagagaaaaagcgaagattcataacgacaaagccgcctcctatcatccgtcacatccgagtgtcctgtataatcaaaacgtgctcggcacataacatcaaaaaaaagagctgccccgtatgaagggcagctcctttttgattacgctgtcggaattcctccgcttacactgtaaatttgggatgtcacatagcttgattcttctgaggccaaaaagacataaattcctgccagctccgccggctgtccggcacgctttaatggaacggccggtgtttccttgccgaatttcggaatgttttctccgggctgtcctcccgaaatctgcagcggtgtccagatcggccccggcgctaccgagttgactctgattcctttattcgccagctgctttcctaggccgacggtaaaaccgataatggcatgtttcgtcgcagcataatccaacagcatcgggcttggattataaccttctacggacgttgtcgtgataatagacgcgccttccggcagatacggaagcgcggctttgacgagccaatacagcgagaatacgttgacttcaaatgtttgatagatttgttctgtagtaagatcgctgatatcatccactgcctgctgtttgccggcgacaagagcgagcgtgtcaagaccgccaagctcttgatacgctttttccgccaattctccgcaaaacgcttcatcgcttaaatctcccggcagcagaacagcttttcttccctctttttcaattaacgctttcacttcttcggcatccggctgttcctcaggcagatagttaatggccacatccgccccttcccgggcataagcaatcgcggcggcccggccgatacctgaatcgccgccggtgacgagggcttttcttcccttcagcttgccggctcctttatagcttgtttcaccgcagtccggcacaggcttcatctctttctgcaaaccgggcggttcttgatattgttttggaaattcatcatgatcatatttcgtcagcgggttgtgcagatttgcatcagacatacaagactctcctttatcattggtgatgtattcgtatgtgtacccctgagcatgacggatcaaacgtgtaagtgcagtttccgattgataagggaaaacaaaaaaggagcccgtaagctcccttttttatgattctccgagcacgttttcagccattttcgctaaatgctgggcgcttcccgaaatctcctgcatcgtggcagaaatttgttctaccgccgccgcttgaccgtccgtgttctggttgatggattcaattgagtcctccagccctttcagcaggctgtgaatttttttcgtaatctggtcaatttggccgacattgtcttttgaatgagtggcaagcttgcggatctcatccgccaccacggaaaagcccttgccggattctcctgctctcgcggcttcaatggccgcattcaaaccgagcagattgctttgatccgagatgcccttgacagtaacggaaatgtcggcgatttctcccgcgctttcactgacttgtttcgcctgagcggaaatcccggtcatctgtgctgagaaaccgctgatggattctgagatatccgcgatcgccgaagcggtctgttccacgacggcggacaggctttcagcgacatcatgaagcttggctgatttttcaaggctcgtgccgagaccgacgccgccgatgacttttccgttttcatcgtgaagcggaatcgctctggcgatcagcggaaatccgaacagctctttcggcaccatgcttgtcttcttctgattcatgcggatcgcgtctgtaatgatgtcccctttttgcagcggatctcccggctttacattaagagaaaacgttttagccggaatattcacgattaatttttctgtatcataaattccgatggtgatgtcatcttggatcaggctgtttaaaaaaggcgcaactttgacaaaagcgtcaagcaggctgtgcgtttgctgctccgtctgtatactcatttctttcactccttcttaatatgggaattggcgtttttcatgctgaaccgaaatccatttcagcgtggtgaattcttcaaggctccattcgccgttcagcctgccgagacctgattgtttctcgccgccgaacgcaacgttcggttcatcattaatggtcgtatcgttgacgtgaatcatgccggtttcgatccgcttagcaaactcaacgccccgctccacgtttgccgtatgcacggctccgcttaaaccgaacggtgtcgcgtttgcgatgcttaccgcttcatcctccgtttcaaacggcatgatgcagacggccggtccgaacagctcctccttcgcgatgctcatctcaggtttcacatcttttaaaatgacaggctcagcgaccgttccgctgaatcggccggacagcaccggaaccgctccctcttctatcgctttttcgacagaccgtctcaggccttccgcctgtctctcattgattaaaggaccgataaccgtatcagggtccatcggatcgccgactttcagcgatgacactttcgcttcgtagagctctgtaaatttgtcataaacagatgtgtgaacgagcacgcggttcgccgacatacagatctggccttgatgcgtaaaccggctgaatacggccgcattgacggcgtattcaagatcagcatcctcaagcacgatcagcgcgctgtttccgccaagctccaacagcggttttttaaagtgtttgaccgcaagctgtccgatatagctgcccactccggttgagcctgtaaatgagattatccgcggcacgggatgctcaacaaagctgtcgccgatctccccgatatccgtcacgatgacattcagcagcccgtccggtacgccggccgcttcaaaaattttcgcgataagcgttccgccgcagatcggcgtttcttcatgaggcttcagcacgacgccgttccccgcgccgagtgccggcgcaacagatttcatcgaaaggaaaaacgggaaattaaacgggctgatcacccctgcgactccggcaggtattctgtacagcctgttttcttttccgtcaatcgtggacgggagaattttcccttccatccgcaccggaaatgttgcggcttcttttatcatatttttgacaagtccgatttcaaactcagccttcagccgtgttccgccaagctcctccatgattaagtaaataatcgcttcttcgtgctcttcaatgaaagaaacggctttttccaaaatggcccgctttttaaaagggtttactttgtcccattcttgtttcgcaagagccgcggcgcgatatgccgcatccacgtcatcaggcgtcgcttttcggaatgaggtgatgactttttgagtataaggatttctgttttccaatacgttccggctgctcccatccctccatcggccgccgataaactgcttatttagttcttcatattgaaacatgtaaacatctccctttcaccgaaacttgaaattagttgatgagtcatcttttgtatcggtcttaaggtgagaaaattgaactatttcacaataaaattccctttccttccgtgcatcgacgctttttagctttgtccttttaaagtggaaaattctttaattgactgcgagaaatttcgacaatataatacaaacgtcagtgtatataatgataagaatattatgaattttcaggaggacccatatgtctttactatttcggaaaaagccgctggccgacttaaaggcccagagcaaacagaccagcctgtcccgctcgttaagcgcttttgacttggttttgctcggaatcggctgtgttgtcggcacggggatttttgtgattaccgggactgtggccgcgacaggcgcaggaccggctttgattctgtcgtttgtgctcgcgggccttgcctgcgcgctcgccgcgttttgttatgcggaattttcttcatccattccgatttcaggcagcgtatatacgtattcatatgttactctcggggagtgtctcgcgtttttaatcggatgggacttaatgcttgaatatgttatcgcgctcgccgccgtcgcaaccggctggtcatcctatttccagtcgcttcttgcaggattcgggctgcatcttccggaggcgctgaccgccgcacccggcagcaaaacgggtgccgtgttcaacctgccggccgttatcattattttggtcattaccgcgattgtttcaaggggcgtgaaagaaagcacccgctttaacaatgtcattgtattgatgaaaattgcgatcattctgctgtttatcgtcgtcggtttcggctacgtgaaaccggaaaactggtcgccgtttatgccgttcggaatgaaaggcgtcatcacgagcgccgcgaccgttttcttcgcgtatctcggatttgatgccgtgtcaaacgcgtcggaagaagtgaaaaacccgcagaaatcaatgcctgtcggaatcatcggcgcgcttgccatctgcaccgttctttacattacggtatcgctcgtcctgacaggaatgctttcgtacaccaagctgaatgtcggagatccggtatctttcgcgctccaatttgtcggccagaacaaaatagcaggcattatttccgtcggcgcgattatcgggattacaacggtcatgctcgctctgctttacgctcaggtgcgcctaacatttgcgatgagcagagacggccttttgccccgcatgttttccaaggttcacccgcgttttaaaacaccgtttcaaaacacatgggtgacggggatcgctgccgccgggatcgcaggttttattgatctgggaaccttggcgcatctcgtcaatatgggaaccttggcggcctttacagtcattgcgatcgccgtcatcgttttaagaaagaaacatccggagatcaaatcttccttccgtgttcctttcgtgccttttgtgccgatcatcagcgcatgcttatgcctgtatctcgcaagcagcctgccgggcgtgacatggctcgcctttgtcatctggatcgccgccgggatcgtggtatatatgatgtattcgagaaaacacagtttgttaaataaataaaaagggaggctcttttttctgtttgagaaagaagagccttttttgcccttgataattcattcaccttatgaataatatggtgtatgcttcgtttacataaaaaggaggagaatcactttggcaattgccgccccgcttaaagaaaaacctgtccatcgtcccgagacaaccatgtattctattttgttcattatcgggatctgtcatctgctgaacgattcactgcaagcggtgattccggcgatgtttccgattttggaacgttccatgaatcttacatttacgcagctcggaattatcgcctttacgctgaatatggtgtcttccgtgatgcagcccgtcatcggctggtatacggataaacgcccgatgccgtatgctttgccgctcggactcaccgcaagcatgctcggcattttaggtctcgcgttcgccccgtcttttctgacgattttatgctgtgtcttttttatcggccttggctccgccgtctttcatcctgaaggatcgcgtgtcgcttacatggccgccggcgaaaagcgcggattggcgcaatcgatttaccaagtcggagggaataccggccaggcgatggcgcccttgattaccgcgctgattctcgttccgctcggtcaattcggctctgtctggtttacgctagtcgccgcaatcgctgtgctgtttctcatttatatcgccaaatggtataaaggccgccttattcatttgcgcgccgcaagtaaaaaatcaccggccgccgctgtgcagaccgtgattacaaaaccgattattcttgcacttatcatgattatcttcttaattttcgcgcgctcctggtatgtgagcgcgatcggcaacttctatacgttctatgcgatgaatgcctatcatgtcagcattcagcaggcacagagctacatcttcgtctttttatttttcggagctgtcggaacgtttctcggcgggccgcttgcagaccgtttcggaaagcggaacgtcatcatcgtttccatgacggcatcggctcccttgacgattttccttccgtttgcgggacctgtcatcgcctatggcgtactggcgctgatcggcgttgttctgatgtccagcttctccgtgacggttgtctacgcgcaggagcttgttcccggcaaaatcggaacgatgtcagggcttacggtcgggctcgccttcggaatgggcgcgatcggagcggttgcgctcggagctcttattgattcagcgggattgacgccgaccatgacagccgtcgcctttctgcccgttttaggtctgctcgcctttgtcctgccgagcgacaaaacattaaaagaatggcattcataaaaaaatccctgccgaaaaggcagggattttatgtttcaaccgtataaaaatgagtgtcaggaaccgcatatttcggaataaacccgtctctgaaatcaggaaacgctttttgaatttcatcaatccatttttttacgtttttgatgtacgggacgtaaatcatactgactgtcgcctcatcatcaatgtgatagtaccagcagagattgaattcgttctccgtgacgagcgtaaagcctgaaaaatgataaaaaatcagcggggtgtcattgacatatacagccccgtcgcgcaggctgacgtcatattgctcaatattccacagcgccgcattcgcgccgatcgactccgtgacatgcacgtgttcaaactgcgcgggccacttttcaacatacctttggtcaccgtatgtctttttttcttcattcatctccaccgtacaataggagatgcaatcctgtctccactgccagaccgcccgatacgcttccccggtattccgcgcgccgacaaacccggtgttgtactgccccgtcagcttgtaataagacgcaaaccgttctgaattgcggtgatccgtcagaaaaagggaagcatccggcttttccgcaaacagctcgcccgcatctgagaagaaaaagagatcggtgtccaaatgggcaaaatattcggcttcatcatactccgtcatcacatggaacagaaaagccggcttcagcgtccagcaatattcatgaaacgtccggccgccctttgcttcaagcagctccgggtcctccatttcatggagctgaaccgctgtgacatgttcccacggcacctgctgaagcagttcgtacgctttctgatcgacacacagcacatacagatgaaaatcccggcaatgctcatggagagaatgaatcatcggcatcagtttaaagatatgcgttctggaaacaatggttgaaaaatgatatttactcaccatatcacatccaatttatttaagatccacatgcagtaaatcagcagtcagcgctttgaacgcccttgcaaagtgcgtgacgcccagctttttttccgcttttgccaaaagctttccgacctccggcagctggaagctgttcgccgtgatccgcgggcttttcgtcttccagtccggatcgaggttgcggtctttaaccgcgtgcagcagttcgagaaaaatgtgcagcaggctttcatatttctcataatcaagcagcacttcgatgtctgccattatgctgttggttaactccgcgtcaaacgggccgttaaacgcgaggtgcacgtcaagcgaatgaatgtcattgtacttgtcgcacatgtacgcgatattcgccctgatgtcatcaacggaagcgcagttgctcggatgctcctgatggacgctcatgatatcgcgccgcagctgaaatctcattcccgactgatgaagcctgatgccgagatcataatcttcaaagccgtatctgacaatgccttcatcaaacaggccgagatctgccacgtgctgcctcttaactgatgaattgttcgtaatgaaaaaacgccatggcagacggtagccgttcaaatcatctccgtatttttccaaaatgcttttcagcacccggataaagtcggtatctaaatcaaagcatcgttcaagaaagcttccgtctctgatgtcactttcatcaaggagcggctctttatcgcccggcagctcttcatacagttcggcgagtttttccttatgctctttttcaaaacggtcataataaaagctgtaaatccgcttccagaacataccgcatacgacaagatcgtcccggttctcatgagccttgatatgcttcgccaccaaatccttttcggcaagcatgtcgctgtcatggaaaatcaaaatatcgcctctggcattgcggaccgcctgattccggccgtaagcgatccctctgttttctttaattctcacaaaaatcagcggaaaattcgcgctgaatgattcaagcatggataaggttccgtcttccgaaccgttgtcagccacaatcacttcgaacggctctgtgcattcctgttcattcagggacagcaggctgttataaagcctctccttggaattatatgcgggaacaatgacgcttgccttcacttttcgttcacttcctgtatatgatcatttatttgttatcatcctcagatgcaaagccgctgaactcggggcagacggcgctgaccgtcccgatcacccgcttcagaatgtcctgataaagctgatggacaaacggcaggtcggtccggtccgtctcatgaatctgccgaatgtcgccggctgtgacgatccggtatccgctgaaatgatagaaaatcagcggatttccgtcttcgagcacaagacgcccgtccttccatgaaaacgtgtggcggccgtaattccaatggccgatattcacgccgggcgtggtgatgtcacacacgttcgggaacagaccggacatgtaatccaagtagccttgatctccgaattttccttcgcccggcgcatttttgcattcttcaaggcagcgttctttccaccatctgagacaatctgtgccggcactgtcggttttgaagctgagaaaaccggaattataccggcctaaaagacgctgcagcatgtcgatttcctgtttttcaaatgagggaatgacgatatcgccccgtgacagaagcaccgaacaatccggctgattgtcaaaaatcgcgcgcggatcagcgaagaaaaacaaatcggcatcaatgtacgtgacacgctctaattccggatgtccgtccagcacgaattcgagaaataccggcttcaccgtccagcagtattcgctctgatccctcgtccgcttcagttcaaggagctcctcattttccagtgcggacacctgaatcaaggtgacattatccggacgcattgcctgaagcacgtcataggtgtcttgatccatacacaaagtaaaaatgggggcgtccgcctgaaccgctttcaatgagccgaacaaagcgatagcctgatacagccttccttttgataaaactgtgcaatatgcgcttgtcacgtctttctctcacctctgtttctgttacttttgaaaaaaggctttataccattcgatcgttttttctaatccttcatcaatggtatgcgcgggcgtccaattcagaagcttcctcgccttttccgctgataaatattggtgcttgatttcgtggcttccctggttaagcactttcggcttgaggtcactgtccatcgccttaagaattttttctacaagttccagcaccgtcagctgaatctcattgctgaagttgaacgcttctcccgcaagattgagctcctccatcttttccgccagcaaaaggtatgcctcgaccgcatcctcgatgtaaaaataatcacggataaatgtgccgtcgctgcggatttccggcgcttcaccgttcagcacgagctgaatcgtctgcggaataatccggttgaagttcaaatctccgccgccgtacaagttgccgcagcgcgtaatacagaccggaagtccgtacgtattaaaatatgtgtggcttaataaatcggcacagctttttgatacgtcatacggatgtttgccctgaagaggcatgttttcatcgtacggcagtgtcggctggtcgccgtacgctttatcactggacgcgacgatcacccgcttgatgagcggatgcctgcggcacgcttcaaggatgttccatgtgccgagaatattggcttcaaatgtggaaatcggattgcggtttgcgacgccgacgattgcctgagcggctaaatgaaagaccgtgtcaatttcatactcgcccagcgcccgctcaatcacatccagatcttcaagcgcgccctgcacgatattcatttgcttcacttgttctccctgatacaggttcgacttgggcacagtgtcacggacaagtcccgtcacattagccccctgatcgatcagttccttcaccaagcagcttcctaaaagacctgtacatcccgtcacaaacacatttttatttttccagaaactcaaacttgatcaccataccttccatacatgttgtccccggtcccacatcttgttaatttccagcagatttttatacgtatcgatcgccgtccagaaaccgtaatgccggtataccgccaattcgccgtcctttgccagctccttcagcggttcttcttcaaacatgacgtccctgtctttcggcagataatcaaataccttcgggctgagcacgaaaaatccgccgttgatgatgccgtcacttgagtttttttcagaaaagcttttcgccataccgtcttcaaccgtcagcgttccgaattgcgaggtcttttctataccggtgacggttgccgcagccccttttgattgatgatagctgatcagatgaaacaggttgatgttcgccagtccgtccccgtacgtcataagaaaggtttcatcaccgatgatgtccttcgcctgtaaaagccgccccgctgtctgcgtgtgttcccccgtgtctaaaaaagtgattttccacggctcggatgttcccaatatccgcacttctccggtagagctgtccagcgtcatgctgtgattcttccagtcataatctaagaaatattccttaatcatctctcctttgaaaccaagaagcaggataaattcgttcacgccatagtattgatagagtttcataatatgccatagaatcggtttgccgcctatcatggcgagcggtttgggacgttcattggtgatttcgctcattctcgttccttttccgccgcagagaatgactgctttcatctctacccctcttctctgtgaatattggattcgaaaccgcccgtataagagaaaccaacccgataatttgtccgattctctaccaccggtttcaaaatctactgtaagatatgagagattggcgccctttgtgaccaaaagctctctcttttttcagattggtgaagatacacacaaaaaaagagcctcacggaaattccgtaaggctctttctattatttattatcctgattcagcttttctttgccgtaatgatatttagacggatcaaccggcgtaaagtcgctcaatttgtggaatctgagcaggtctttgtacatcacgctgtcagacagcttcagctgctctgtgactctggctttcaggtttttcgtttcctgattgcctttcagttctttccctgtcttcgtatcgtatacgacattggagatggaagtatatttcggcgtgacgtaatctccgttgcggaacgtcaccgtatcatcatggtctttcgagaagagatcggtgccgaaattaatatatttcttagaatcgatgccttccaagtgaaggatcgtcggcacaacgtccatttcaccgccgtacgtatggttcaccccgccttttttgccggggatgcgaagcataagcggcacacgctgattctgcgcgttttgataaggcgtaatttctttgccgagaatttctttcatcgcgcggttatggttttcagagattccgtaatggtctccgtaaagcataatcaccgagttgtcatataaaccggatgacttcagatctttaaagaactgttcaagcgcttcgtcaagataacgcgccgtctggaaatagtcatccacagtcgcgtcgcccgttttcgctttttcgatcgttgcgtctttttcatcaagcgtaaacggataatggttcgtcagcgtgagcaaatgcgcgtagaacggctgtttcagcgactgaagcttcggtatagattctttgaagaacggtttatccttcagtcccatattgacaaggttgtcatcagacatatcgtatgtgctggcgtcaaagaatttatcgtagccgatatgtttgtaaatctggtcacggttccagaatgatttgtagtcaccgtgtaaaacggcgcttgtatagccctcactttggtcaaggatggcaggaagcgattgatacgtgttttccccttttgtcacgaaggctgacccttcaggcagtccgaacagactgttatccatcatcagctcggcgtcagatgttttaccttggcccgtttggtggaaaaagttatcaaagtacgtcatgtcctctccgccgcgggcgagtttattcaggaacggcgtaacttctttcccgtcaagtttgtaattgatcaaaaatgattggaagctctccaggtgaatcttaatgatgttcttgcctttggccttgccgaaatactcggcgttcggcttcgcataatgcgacgatgtatagttttcaacgctcgtcaggtcatcactgctggcatatgcccgctgtgattccgtctgcgccgtctgtacgccgtcataaatcgtgtaattataaaggcctaagtattttacaatgtaattgcggtcaaacgttcttgtcagcagctccgggcggtcctcttcggcaatcgccaggttcacgaagaacaacacaatacccgtcacgataattaatgacgtataccgttttttcagcttgaattccttcagctcacgtctccacaccagaagcgcgattaaaataataatatcaacaaagtataaaatatcatggccggacataatgctgaagatgccgtctcccatatttccgacattaccggattgctttaagttcgggaatgtcaagaaatcatcgaagaatcgatagaataggatattggcatacaaaataaacgtcatgatgaaatcaataatcaccatgataatcgctgatttgcggcctttcgcaaacaatgccagtcctaaaaagaaaatggcgcttgagaacggattgatcacaagcagaaactgctgcgtcggacccttcaccccaaggttgaattcagcatgataggctaaatacgttttggcccaaaacaaaataatagccagtacaaaaaaactaagtctgtaagaaaataatttcttcatggcaacctctactttcctaaacactttaaatctgtattcttactttttgcttcaattcctgctttccgagcaaaacgaaagcatcacacagccccataaacacaccattttaaaaaacgatatatttatcattcgtgtcatgcctattgaacatcttatcccgccagccattagacgcaggatatccgttcttcgtttcacatttttttctggcattaaaaggtaccttatcagacccggtctgaaaataggagataccaaatataagaataacacaaacttctaaaaacgaaaaatgaatatcaaagacagccgcccaacaggcgggctgaagttattgtatgcaaagggactgaaaaacttgaaggttttttttgggtgatgtaaaaaaaggaccggagtcatccagtccttttcatcacatcgctcaaatccccgcccaaacatcttttgcgtaaatgccttttgtctggaggtccaaaagccattcttgcgcttgccgttcgtctgtttcgcggaccgactgatacgctttttgcagcgttgcctctacatcgggcgccattttgctgccgtctccgcatacgtagaggcgccctccccggccgaggatggaaattaaagcgccggcgtctttcgccattaagtgctgcacatacgttttcggtacgccttctttgcgggagaaagccgtatgaagcgtcacgattccgtctttttcataagcttcaagctcgtcacggtaaataaaatcatgatcgtttctgcatccgaaatacagatgagcctcccccagctcttttccttctttttttaacgctgcccgagcctgcagaaatccgcggaacggggcgactcctgtgccgggaccgaccataataatcggtttttccggatcttccggcagccggaatcgtgtttccggagtgcggacaaacatcacgataccatcctcagggcggcggtccgctaaataattcgaagcgactccgcgatactcacccaaaccgctccgggcggggccgcgaacgacgccgacggtaattgaggcctgcccgggatgtttccgaggcgaacttgaaatcgaataataccgcggcttcagcgggcgcaaaagctccagaaatcgctcaaacggaagttcacacgcttcatatttttcaaggagatcgagcatcgagacgcgcgatgttaagatttgctcctgatagacgccctcctcaagaaaatcttccaattcccgtttgtgcggcggacagaccgtataagcggccatttcccggatttgagcccttgatgccgcttcctgcaattcgacacagctgctcagaagatcatgcagcctgaccggccgatcgagcgggagatgagccgcgctctgtccgctggccgtcagcagcacttgatcattcccgttcagattgaaccggcggagaacacggctgacctgctttttgctgtttaccggcagcacgccgagatgatccccttcatgataggcagcctctttcggcagagtgatttcgatatgccttgtgctccggccgctttccggcgcctgaagttccctgttttccgcaacggatgcgtaaaccgcttcatacgtctgtgccaacggagacccgccaagcccgctgacaaattgaaggcccagcgcacttcgctctttttcggcattttcattcagcttaagaccgaatgccttcatggcgtccgtccacatgctttttttccattcatcaagctttccttcaaaatccccgctgacgtccccttcgcctcgggcagaaaagcgttccgcccctttttcggcaagcttctcatcaatcagtctcggcacagcctgatatgtcgccgcccagttatgatcaccgcagccgaagacggcatatcggacaccttccagctccccgggtttgacttcttcaagccattgaacgaattgtcccgcgttgctcggaggctttccgttataagaggacgtaatgatcaagagagctccttctttcggcagttttccgatccggtcatttaaaggcgccgtttcagtccggacgccgtgcatcccggcagtatcggcaagttcccgcgccacgccttctgcggttcccgtatctgagccgtacaaaatcagaagcggtcggttatcaagcccgataatggatgcgccttttgtttcccgtttttctttttcgacgtcttccgccgctttttcagccgccgggagagctgccgcaacggctcctttgtttctcggccgcacccggatatgaaagtcgccgggcttaatcgtcagtgtctgtttaatatcgagctcataatcggtgtgatcgataaaggtaaaatgctgcagaatcatccccagaacaagagttgcttcatgcagggcgaactgcataccgatacacgccctctgcccgtttccgaaaggcttatacgcatggtgaggcactagatcaggatgttcaaaccgctccggataaaattcctccgcattgtctccccacgcgtctttatcacggtgaagctggggaattaagacggaaattctgtctttcggcgtgatcggatatttcccgccgatcaccgtatcctctttcgcataaaggctgaacgcaggcgcggtcggccataagcgcaatgactcctgcaaaatcattcggatataactaagctccagtacttgtttataagaaggaacgggatcggtcaaaacccgatcggcttcttcataggctttttccaaaacacggggatgtttcagcagaaaatagatggcaaaggaaagcaggccgctggtcgtttcgtggccggcaattaaaaacgtgatgatttgaaaccggatattttcatcatcaagtttttcgcccgtttccgggtcttccacattcagcattctggccagcagatccttttcatcccgtccgcctgaccggcgctctgcgataatactgtctactaacgaaaacatcgcctgaatgtcatgatgaaattggcgcttcgtcctgatcatgagcttatcctgaacatcaaggcgctgcatttggtgcatcgcttcatcaagggcgcgcaccatgctgttgataaacggatgaggcgtttccctgtaatagctgttaaaccgatagttaaagccgcaaagcccgatcgtatcgagcgtcaggcgggtcatatcagcaggcacatcaacggcctcatccgggttcagcctagcccatttttgaatcagctgcaccgcgatatcagtcatcatcgaatgataatctttcatcgcgcgctggctgaaggtcggcatcagaatattatgcgcctttcgccagttaggctcatgcgtccagcttgtaaacagcccgtcaccggcaaacgcccggactttctccaaagcaccttcaatgcttttatcgaaccgctcttcatcacatacctctttcaccagttcatgtccggacacgacgataatggcgcccgccggggtatgcagctgaaaaataggcccctgctcgtttgccagtttgatcagcgacattgtaggcttgtctttatcaagcaaaggaagattgccgagaggaccgaatgtcttcggctgcggaatcggacctgtttccttcatgaataacaccctttcttacacattgatgcgttccttccaactacagtgcccttttcaccggccaattatccgccgttacggatcaatccccggattgacgattgataacggttttttctatactggagaggcttgttaaatacagaaataaggtgagttcacatatggattttgaaatcaagtttttatcgttttatgtcattcaagtggaaggaaaagacgaacaggcaaacaaacagttcaaacatttccagacccttgacacagacgaatttgaagaaagcgagctgaaggattttcttgacggggaattgaagaaaatcgtcaaacggaaagctgaacggcatccgcaatccgagcaggtccccacaaaaatcggccattttatcacggagccgggccatgagcttgattcaaatccgaattacaaccttttcaaccgcgccagacttgcggatacgaaggaagcatttatcgaggcaagcgaacagttcgtccgtacttatcttgacacgagcgccgtgcgcggcggtgtttttatcgtggcttcggccgttccgcgcaaatattttgaggacaaattcgtctttatgatgaaatgcgatttcgagccgaaggtcgcccgcatctcagacgcctcgtctctcattaaaaaggtcgaaatggccatcacgacaaaaaacatgaaaagcattcaatatccgtatatgccggaagaaggcatgacggaagagcatgagctgaaaatccaccaggcctcgcacgcccgttatttcgaagattttctcaaatttgtcgaatatggcgaatcgatgccggaaatcatgaaaaaccaagtcatgaacatggtgcaggagcacgtgtatgaaacttttgaagaaaacagcgaagagcttcagcagtttgagcacgacattgaaatttgggaagcgagtgaaaagcgggaaattcaggagcgcctcgacacccatcaagtcatcgaggcatccgcgcagatcattgaacacacgccggaagccgagctgaaaatgaaagtcggagaaacagagattaaaggattactggctgatttcggcgaatccatccatctcgcaaaagtgaacgggcgctatgtcgcgctcattgaggcggagacgatctcgtttgaaaaaggcagttcgccggtggagtttcacaagcctgaggggctgcatgaggtgattgagcggatacggaataaatctgaacaagactgacaaaagtccagacgccatgttctggactttctgtatttaataaggctctttgagcaatcgatagcattcaccgatgatgtcttggacgccgggcgttccctttatctcgcggcggacgatttcagatgagagattctgcacctgtaatgcccgctccgcccgtctttcgaagtatgcttgacatgcagtttcatggttttcgtgtttttgcagttcttcactaagcacaatcgcgtcttcaatcgccatcgccgctccctgcgccaatgtcggcgctcctgcatggacggcatccccgcccagaacgacgcggcctctgtgccacggttctttgaccgccatctgctcaatcttatgaaacaaaacgggatattcctttgacatattctctgtcacaaacttcactcccggaattccgcgcagcaagtctctcacccgttcaaaacgcgtgtcctcgtcatccctgaagtcagcgtcatacggccggatgataaatacgtatcctgttttttcagagagcggcacgaccccgacctgcgtctgcccctttttatacatcagtgtcgaatcatgaaaaaccggctcgggaaaagaaatgtaaaatctgtgcgctcccatgccgagatactctgttttcacttccctttgcagcatgtgattgcggacagcggagcggatgccgtcaaagccggcgaggatgtcagccgtcatcgcggttccgtctccacaatgcaccgttatttcatctgccgtttcttcgtaagacacgacttttttaccgggcagaatcgtgacccccgccgcctcagcatgcttgctgaggatatcgtttaatgtttgccgcaatatattattccgccccggcaatgaatcatctaaaaacgcctcactcactttaaactgcagcgttccgttttcatcatgctgcttcagccaatccgtttgaaagccgtgttgacagcattcatcatacacaccgatttcccgaagcacccgaagcgcattttgaggctgaagaatgcccgctccgctttttcgcatgtcggacgccgcctcgcaaagggttacttcaaaacccgctctgccgagagaaatcgctgcggacaggccgccgatccctccgcccgctatgatgatctttttcacttcatggttcatcacgataccgccttctcaatttatttatcatttgttaactattagccaccttactatattggctgaaaaactgtcaatctttataggttgccttttgaatccggcaagcttatactttgaatcactaaaatggtacggaggcttacaaaatggaattgagacatttgccggattactcgcagattgccggacgcgctgagatttacgccgatatggatgctgaatcattgaaaacatttttgacgttatttgatatgtctaaaaaaatgaatcaggtcatggagcattatttctcaagtcacggattgtccgaagggaaattcaaaattttaatgtttctgtttgacgaacccggccacagcctgagtccgacggagctggcgaaaaaatccaatgtcaccaaagcgaccatcaccggattgatcgacggactcgcacgggacggctttgtaaaccgcagccggcataccggtgacagacgaaaaatcagcatcgaacttacaagggaaggaaaagaaaagctgatgctgtttcttcccggccacttctccaacatttcaggagtcatggaaagcttcaccgctggagaaaaagcggaattgacaaaaatgcttgaagttttatttgataagcttctgctgttttccggagacagaacataaagtagtattgtaaaaacaaaggcaaatttctatgagatagaaattgaagtaaaaagatgagggttataaaaaaacagcctgcacattagtttgttcaggctgtttcagaagaaataattttaaaattactttctcttcactataaatgcaggtgttttaatgctggaagttacatttgtatatcgatttttagtcttcaacctcactctcacactatttgatcctttttttaacgatttttgatttgagagtttaaatacttttttaggtgttgagtgactgaaagaacctttctttgtttcattagccacccattttgaaccgttccaaacatcaattgtcatggaataatcaaatgttgcgattgtcccgcccccatatgatgctacacaatcaatagaagtagcttttgcagaataagaatccgcatcggtacaaactctcaatacatatgttgcataatctgtactacaaggcataatatccttcccctttcaaattttttgaaacaggtttgttattatgacaaaccctccgttcacttctagctggcaaacgtatgacaaagggaatctcatggcttatgagattaaaaattcaaaactcttaaaattaacaaaaggcgcccctcttagcagggcgcctttttcgcgcgattaatcatcactgtttaaaatcccgaaaaaccgaagcaggttgataaacaagttgataaagtcgatataaagcgtcaatgccatcaaaggaatcaggtcagccgtgatgtcccggtgcttgatctggttcagatcgtataagatgtacattgaaaacacaattgttccgatgacggaatacgccatcatggcggcggaattcagcgggctgaaaatattaaatatccccactgcgagaagcgcgataagagcgacaagcaagaaggaccataaaaacgacaagtcctttttcgttttagcgccgatcgtaccgagcaccgcaaaaatgacaaacgaagaaccgaatgcctccaatacgacataggctccggctgcggacgcataatggctgatgatcggaaacagcgtcattccggaaataaaagcgaatgaaaagacaaacacatatccgacggctttttttcggcgcagccaaaatgcggcgatgatcatgacgacctccaagaccgacagcggcagcatcaatgccggcggaatgaactggcccgtatacaggccgattgtcgcaactaacagtgtaaacacaaataccgtgataatgcgctgcataatagattgtttgctctcataagcagcagtttgcatgtcaaaagtcctcccaaaaaatgatcgtgataggtctattataaataaaatgggagaaatttgcatgattttaagaagattttaaggatgtcaggcctgacgtttcgctgcgcactcctgcatatccatgaaatcatgcagttttttcgtcaatccgccgtgcccgaatcggatatttcccttctgccccggcgttttcacgaaatcaaggaatgccagcacataaagacgcctgacgggaatcggaatgacgcccgcatcataaaaccagccgtcaattgtattgagcacgcctttatttatgccgtattgcttcgtgcaccaatgcagaaagcgcacttcgggcaggtgcagataccggctctcccggaaaggaacagttgaatgcttcatatgtaccgcctcctgtcattggctgttttttaagattgttttacttctttgcttttcagggaaaatcgatatttctccaccttatcaatttgtgtcacttgggaattatgaaccgtaatctgaacagtcccgaaatcgagcgtttccagcgcactgataatcttttcgatcacatgcggatctacgtttcctttggacgtcatcatgctccccctttatgtctggacgttcgtcttttgacaatgagtgttttaatccatactattctgataagaaatatataattatactattatgttttcattcagaaatcaacagcatttacacaattttcggatatgttttctttgcgaaaactttcacttcctttgctttgacataaaccgtgtcgccgacgcccgcccccaaggcgtcatattgctgtttttaagaacgcaatcttcacgttccgacatatttaaattgttttccgctgacaaaaaaagcgccccgcctctggacggagcaccttttttctatgcttttgcttcctcgatcacacatgtgacacccatgctggcgagcgcctgctccagagagccgtaagtttgatactctgaaaaatcaagtcccaattggatagaagtctgtgccacatcaggccgaatgccggaaaacacggttctgatgccgaggagaaataacgttttcgacagcatatacaattgctgcgccaccatcgtatcgacaatgggcacaccggacagatcaattacaaggtttgtgatccgtttggcgacacagttttccggcaccgactccaaaatcacacgcgcccgtctcgtatcaatcgcgccgatgagcggcagagtgccgatcgtatccgcgatcaaaataaccggacagctcaattcggaaataagctcctgctgagatgacagcctcgcgatcattaatttctgaaactgttcagtaaaatccgtcatcagctgatcaaacgagccgttgacaaggtaattccagcggcgggcatcctcatttgttacaatgtcctgatgctcatccataaaacgggtgaccgcctcccaaaagacggttcttgaattgccgatcgcctcaacgacctcatgaacctccgcgtcttgctccactctgcttttcgctacctgagcggcccatttttctttgttatgctgaaaaacggccggatcttccaaaaaagcgcttgcgatgaccgtgtttgtaaaggtatgctgctcgatcagcagccgtttcatttcctcacttaattgatccgcagaataaaaacgccctctcagcttccgtctcagcttgagccatttttccgtcagctctgccgaatgtgtaataatataatcatgaagtaattggtctttgttcactgccgtctcctctttcaagaatatgtacttttgtctaaattataaatcggaatcaccgatcgcactagagaaattaaaaaaacctgcacattaagcttttgattgcttttttcggcaggaggatacactataaaagaaatgaaacaggaggtcagtatgatgatcaaaaaaatcgcgacagtcgccgtatacactgatgatcagcaaaaagcgaaaacattctggacggaaaaagcggggtttgaaaccgtcgccgagcatccgatgggaccgggcgccttctggcttgaggtagcgcccaaaggggccgccactcatttggttatttatccgaaatcgatgatgaaaggcgccgagcatatgaaggcttctatcgtatttgagtgtgaagatgtctttgccgcatatgaacagatgaaaaggaacggcatcacctttttagatgaaccgaaacaaatggaatggggcagcttcgtgcaatttaaagatgaggatggtcatgtctttctcctgaaatcgtaatccgtcaggcatcttaattgactttgagaatcattttcatttaaaatgttggataaaacgtaaaaaggattggagagctgccagatgtttgtgcaaatcagaaacatgaccgtaaaagaaggacatgccgacaaagtaatcgaacgcttcagttcagaaggcgtgattgaaaagcaggaaggtttgatagacgtaacggtcctggaaaaaaaagtccgccgcggtgatgaagaagtcgtcgtgttaatccgctgggagtcagaagaccattggaaacaatgggaaaaaagcgaagaccacatcgcggcccacaaagcaaaccaaggcaagccgaaacctgattatatgcttgggacggatgtcggtatgtatcatgtcagagccgttaaaacaggcgtacacgaaaaataataaagagcatttgccccagggcaatgctctttttattttttctcctcaaacggcaggacaaacagcggtttatcgggcttccattccgcatacagcacgtcctccgtttttttgatgttcagctttttcagctcctgattcagctgcttttcttccagcccggcttctttcagattttcatacagcacttcgccgtcaataatcagcgtgaccggcaaagagacttgcttcggctttatttgcatgtcgccgtttttcgtcgtgtcatattgaaatttcggcaggacgctgaccatcccgtttgtttctaaaattgcgtactccgcttcctgtatagaaaagcaattcgcctgtctgagaaggctttgcaattgattaatgtccagcttattctttttcagcacatcatatttcagttttcctttatgtatgataatactcggctcgccctccaacagctttctggagctttttactttctgcgtaatcagttcgatgagataaattaaaaccccccataacagagaagcaaaaatgatttcaataatcctgacgcctttatcatacaccgcatttccgaccagttcgccgaggatgagcgcggaaataaaatcaaacggcgtaatttgtgagaattgagtttttccaagcaattttaaaatcacaaataaaatacccaagccgcatactaactcccaagccactgtaagtaaatgtcccatattcgcaccttcttcttaaaagtcattaccattatggacattcgcctgttttctatacagcggccggcaatacacaaaaaaacgcagacgaggctgcgttttttcacttctgcttactgtttttgattcgatctgacgacccgtaagcatacctcagcggcataaccggcggccgctccggaacccgtaaacatcgcggcaagccccaagcccatgccttcccagccgccgacaccgaaaatgctgtaaacaaccgtaccgaaagcagtcaggcccagcaccgccaaaagccactcaggccacatctttttcggccatttcttacggagcacagccgatacggcaaagttaagacaaaatgcggccagacagatcagataaaaaaaccccatgtcttttgcacctccgtcatgaggagctttttatttgctcacctttttttcaaacaaatgataacccggcgcgagtccttttgattcgtaacccattccgctgtaaaacgactgaagcgccttgtttccggacacgcagtcgagccggattttcgtttttccaggacaagacacccccgtctccgcccaagtcatgatcgtccggccgagccccgcccctgcaaaccgcctgttaatcgccagccggtggagatatacggactcctcatgtccttcatcgccccatagacgtctgtcccacccgcttgcttcgggaagcagcatgacgacgccggccagctcttcattctgcctgaataaaaaaacataccctttggcgatcgcctcccgcatattgtgggtatcttccccttgcagaaggccgctccactggttcgaccctttatcgcgaagccattctgccgcctgcacgagcagatccatgacttcttcttcatcatccttccgggcggaggtgacccggaatgcccccgccttctcctccgtaatcgtaaatggtgtcataaaatcctcctgtaatcagaatattcgacacctttattatagaccaaacgcagaaaggaaaaaaacagccgtcatgtttgagggccgtttaaaaaattttcttcttatcacgttcttcttttaaaatctcaaccgcttccctgaaacgcatagagtgaacgatttcacgctcacgcagaaaacggagtgaatcattcaggtcaggatcatcggaaatatcaataatccattgatacgtcgctctcgccttttcttcagccgcaatatcctcatataaatcagcaatcggatctcccttcgcctgtatgtaagacgctgtgaacggaacgccggccgcattgtgataaaacagcgcgctgtcatggttgacgtaatgatcactgagccctgcatcacgcagctgctccggtgtcgcatcttttgtcagcttataaatcatcgtcgcaatcatttctaaatgcgcaaactcctccgtgccgatatccgtcagcaggccgatcaccttgtcaggaatcgtgtagcgctggtttaagtaccggagcgctgcggccaattcgccgtccgccccgccgtattgttcaatgagaaacttagccagcatcgggttgcacgtactcactttaaccggatactgcagctttttttcatatacccacatttacagatccctccttatacttgccatggccaaggaccgcggccccagtcccattgagcgccggcctgactcacgccgaattgcagaagcggtccgtactcaggctcaaaccgttttctcagctgccttgagtaccgggaatattcatgaaactgctgaagcgcgagacggtcatggggatgcgtatccagataaagcgtcagctccaccaagacaaagtccgccgcctgaatttgctccagcagccgatagtattcatcatcaatctttttcgccatattcgattcccccccgataaggattatcatagaaatcgtaaagatccttccaaagggtcccttttcttaatgcctccatcggagaaaactgctccaagtgataaggctgaaaccgcatataaagatgcggcggcgttctgtagtattttctcccgatcggcgggcagggatcaaaccggctgtggaagggtttataggatttgaccggtgtaaacggctgattttctttcattacgatcctcctttcctaaacacatgaccttaataggtatgaatccgtatcagcatttatgccctgtaagaaaataaaaaagcccgttaaaaacggactccatgcagctcatctggaatttgaagtaaaaaaatcataatgaaaaatctgattgaaagcactgataatgtttcaatgtatattccgtaatttgctgatcatattcaggatattcgtatctcaataaaacagccactgactttgaatatgctctgaagagaccttggcagtcaaacaatgccttccacacgctttcataagtattgccgacataagtattcagcagaatttcccaatctttcgcattcatgtaatgttgaatatacttataattcttccctacacttaatgaaaactgatgctctatcccaatattccacgcaatcatacgcaaaacattaggccttaaaatgtcattcatatggtccagcgcaaacagtatttctttgcgcattaatcctttaatcacataggttgaaaccatccaaaattcattgcagcaatcatcaaactctccgggggtcggtttctttatatgatattgttcatcactcgcaatcatcttactgttgattcggtcatccttgtctaataatatttccgccaaaccatcactctgtgtaaaataatcctctgtttgactcagagggatcaaagttaagtcgattttatgatgatctttaaaaagcatgagataggagaaccagtctccgagttccggagggaaaagttccatatcttcaggtttttgcatcatcattctttcgccaaactgatccagccagctttcatcagatataaaagagtccatatcggtcacaaaataagaaatatcatagtcttgaaatttgtctcgcggtacatttttattggttcttgatccctctaaagtgacaagacggattctctcgtccttcatcgcaatatcaagaatcaatttcatcatttcgtcttcacttctcacatgtaaaacctcccgataaagagatttttacagatcatgcttttcagtttataaacaacttgctcatgatttacagaaatgtcatatgtacttgatgattttgctccaatcgtaccacagctgcaagaacatgagaagagcactcttgctgttccaagagtgcttttcccgaatggtcagatatattggctgtcccgatgatgatggtgatggaacgggtagccgccgtagcctccgccatagccgccaaaaccgtaccccggatatcctccgaagccgccgtagccgccaaaaccgccgtaaccgccgtaaccgccgtaaccgccgtaaccgccaaaaccgtaccccgggtagccgtagcctccgccgaaaccgtatcccggatatcctccgaagccgccgtagccaccgtagccgccaaaaccgtaccccgggtagcctccgtagccgccatagcctccgccgtaaatcggtcttctttcattcatgatttatcgctccttcacataggttacagtccagtttatgacatgcggaaggaaacgtatgggcatccgcccagttttggcgaaataatcaataattgcttacggagaaatacgatacaggccggccgcataagcaaaataaaaaggccggaacttatgccgccccggcctttttgtctttattcgcctaaatctacattgtgataaacctgctgtacgtcttcgaggtcttccagcacatcgatcagcttttcgaattgagctttcgcatcttccggaagctcgacttcattttgcgcaagcatcgtcagctccgcaaccgtgaactcttcaacgccggcatttttgaatgcctcctgcacggcatggaattgatcaggctcagcatacacgataacactgtcatcctcttctaaaatatcgcgcacgtccacatcagcttccatcagcaattccagcgcttcatccgccgtcttgccttcaacgccgataacggcggtcgcatcaaacatgtaagcgacagacccgctcacacccatatttccgccgtttttcccgaatgcggcgcgcacttcaggcgccgtgcggtttacattattcgttaacgcatcaacgatgatcattgaaccgttcggcccgaaaccttcgtaacgcagctcgtcaaagttctcctccgcgccgcctttcgccttttcaatcgcacgctcaataatatttttcggcacactgtacgtcttcgcgcgctcaagcaccacttttaacgcctggttcgattccggatctggctcgccttgttttgccgccacataaatctcacggccgaacttcgcgtaaatccggctcgtatttgcgtcctttgatgctttcttttctttgatattgttccacttacggcccattttgttccactctctttcacgaattgaatctgtatgataaatactctgcttctattatacctcagcggttgggttgtttcgagtgtaagacattagaaaaaacaggcacgcttaaaatcaccggagcgcagtaagccgaatttgaggattattgtacaaaacataaaaaagcctcccttcatacaggaaggaagtcgcaagtcaaaagattcattttattcttattacctatttcctacactgtatatcctgactcccgtggtaaaattttgatatcgaacaaaagaaaggatatggtcatgaaagttttcgaagcaaccaccctgctggccgctgccaaacagcgcgcgggtgaatacaaaaaactgcgcggtcagatggttaatctgaaaaaagcatttcaaggcgtggctgatctcggtgacggcgatttctctggtcggggcgcagataacatcaaagcctttttccaggaccacgccggcgtcacagacagctggcttgatctgatcgacatgaaaatcgcatttctcacaagccttcccggtaaggtcgaagatgccggactttccaattcgcatgtggaggaatcatttctggagcatgagctcacccacgccctcagtaaatcaaaggcgattatggaagagcagaaaaaggacatgcgctccatcctcggtgagatcgatgacatcatctcgcttgatctgttttcaacggaaagcacagatcagaagctttcttcagctgacaaaaaaagaagcgaaacgatacataagctcggcaagcttgatcacgatctaacgaaagaatacgcagaaaccgaagcgaacgaacagttcatccaagctgacttccagcagcttcaaaatgccacgggcaaaggaaaaagcgccacgccgcttcactacaacgccaaggcgtaccgtgaaagcgacatccataagaaaaaaggcgagattgcaagacattcggatgcttatttgaagatgaagaaagaggaagcgaaggaacgagagattgaaaaactgaaagaaagactgaaaaactacgattatgcgaatgctgatgaattctactcaatggccaaaacaatcggctataaaaacctgacaaaagaacagcagcgctacttcactcaaattgaaaacacgcgtgaacttacagacggtttcaaaggcgttgccgtcggcctttatgattccggaaaagacgcggtcacaggcctgtgggatattgtcacagatccgggcggaacggttgaagccattacaggagcggcggctcacccgatcaagacgtatgaagccatttcagcggcaatcgaagaatcgtaccaaaaagacatggtgaatggcgacacctactcaagagcaagatgggtgtcatatgcagtgggcaccgttgtgacatcagttgtcggcacaaaaggcgtcggcgccgtctcaaaaacaggaacagccgccaaagtgacaaccaaagtcaaaacagcagcacgcaaatccgccgcagcacaaaaagcgataacggtctcaaaacaaaccgttgatcacatcaaacaaaaagtaaacacaggcatagaagtatcaaaaaaacgtgtcaaaaccaagttacatcaaatcggagatctcaccctggctgatattctcccgtatcatccgcgtcacgacgtagtgccggcgggcgttccttacaacgcagtcaacggggtcacacttaaagaaggacttcagaaattcgccaaggtcatcctgccgaaaccgtacggaacctccgcaagcggcagacggacaccggcaccgcatgtaccgccggtaacggtcaaatacggcgagcattttgcgaaatggaccagaaagaaagtattgaagccgaatgtcatctataaaacaaaagaaggctacacgtacaccactgacaactatggtagaattacaagtgtcaaagcagacttgcagctgggagaagcaaaacgcaaccaatatgcgcaatcaaaagcaggtaaaccagaccgtctgacagatgacgacggaggccacctaatcgccacccaattcaaaggctcaggccaattcgacaacatcgtgccgatgaattctcagattaataggagcggcgggaaatggtacaaaatggagcaagattgggcatcggctttgcaagcagaccctccccaaaaagtatcagttgaaattaatgcattgtataaaggtgattcattaagacctactgcttttagggtgaaatataaaattggtgatcaagaagctaaacttatgagaatcaaaaatcaggccggaggttaatatggagacaaaaaaaatggggcaattatatcaaaagatagcagaaagcattaatgagatcattccatctgaatgggaaagagttattctttatgcagaaatacttgacgattcatctgaagttttcttttatttcaatactccacatagtgaagattttatatattctcataatatccctgaacactatcatgtcagtgaggagatttatgaggagctgttatttgacttgcatgacttattcgaggaattacgagatgaatttaaagaaaacaatcaagatatatggactaatctaacacttaatctggggataagcggagaattttcgatagactataattatgaagacgttattcaatctccatataccatctctcaaagacaaacaatctggacttataaaaatgtaggaatttatcctaagagtaaacctttaaaatcctttttagaacagtatttaaattctcaaaattaaaattccccctcctttattggggggtttttttgatacaaatgatccttacaaattaccaattataatgctggaggctgatccttgttggaaaatgaattaaatgcattatatagaaacatagctgaaatcgttaacgaaatgataccagaaccatgggagaaatttttgttctatgctcagattcagagacaggcggaggcacttactttttttacaattctcaaaatgaacctaattattttaagtacagtcttgaaattccgtttgaatttgatattgacgaaaatgaattcgatcagtatgagatggaattatttaaactaagcgaaaaaatgagagatgttttcaaagatcatgatcaagaattattttattctttcactcttagcctagaaagatccggaaaattaactgtcaactttgattatacagattggtttaagacagattatagtttcagtgatcagcttatcatctggaaattcaaatacttaagggaagaacctaaggatccatcattacaaaaattaataaaaaaatatttagatgaatatcctgaaaatccaatttaataaagttgggataatgatgttagaaaaagcttatctaaaaataactgatgtcttaggaaaaataattccttctgaatggagcaaagttgttctgtatgcagaaatactagacggttccagagaagtttattttttctttcaaacacccgaaaacgatgaatatatatactctcatgacataccagaacaatttcaggtcagtaaaaaaatttataccggactactactagacctccaagagttgtttatgcagttacacactgaatttaaagaaaataaccctaaagcatggacaaatttgacactgaatcttgaaagcgatggaacgttctcaattgattatgattatgaagatgttattgaatctgatttggacgaatacgaaagacaaatgatttgggagttcaataacttggggattttccctgaagacgaagaggacaaagaatttgttaaggattatctaaatattaaataatgctatcaacaaaggtagaggatcatcaatggtagctgaaaaaatggaacaactatatcaaaagattgctgaacatctaaatgaaatgattccatctcaatgggaaaagatcgttttatatgctgaaatacttgatgactcagcggatatatacttttattttacaacaccaactaatggtgattacttatattctcattatatacctgaacaatttaaagtaagcgaagagatttacgatcaactgctgattgaacttcaagagctatttgaagaactaaaagaagaatttaaactaggcaaccaagatatttggactaatctcactttaaaattagaaaacaccggaaagttttcaattgattataacgatgaggatgttttattgtctgaacttgatgaccttcaaagacgagatgtttggaaatatcaaaatttagggattttgcctaaagatgaggacgatagaaaattcatagaagagtatctaaacatataataagctttcaaacggctaaaaaaaattaaaaaggattctgatattgtggaaactgaaaaaatgggcgaactatatcaaaaaatcgctgagcaaataaatgaaattatcccctctgagtgggagaaggttgctctttatgccgaaattttagatgattcttcagaagtttacttcttctttagtactccacaaaatcaggaatatatatattcacacgatattcctgaacattttaatgttgatgaagatatatatgacgaacttctatatgaattgcaagattactttgaagagttacgggatcaatttaaaacaaacaacgaggacttatggacaaacctcactttgcatctcgaacgaagcggtaaattcttctcaattgactacgattacaccgatgtcatcgcctcagacttaaacggaacacaacggcaagtggtatgggaatatcaaaacttggggattttgcctgaagatgaggacgataaagaatttgtaataaactacgtcggtctataagtcaataatggctcagcacttccttgctgggctattttttataactacatcataccttatgaatgggcaaaaatatatctttatgcagaagtattagatgactctcccatggttctctttcacttcaagacaccaaaaaaacgtcaactgatttattcgcaagatctaccagcctgatacagtgtaaataaagatatcttcaacacttttcaagagaaatccgagaactttttgaggaattaagaattgagcacaaaaagaataatgataaacaaaacaggcagcatccagtaaacggatgctgcctgttacatcgttatgtatcgtctgaagaagtcatttattttgttttttaaatatgaaaatagatatgacggtaaatatgatggctgtaatgacaatgacccacaagctcgcagccgtactgataaaatggccgtttaacttgtagacgatcccgtaatgcttttcatattcctgtatttggtccgcagaagcatgtttaaacactttatcaactgagtctgtcataaacgcttttctgaacagaacggcggtgtggctgatagggaaatacataataatcttctgcacaaacaccggtacgccgccgatcggtacatatactccgcataaaaaaccgatggctgttccgacaatcgtacttaacgtcgaaaatgcattttgtgtgtgaataaacagcgttaaaaataaatttatggaactcgagagtgcaactgaaagaataatgatccccaatacttcaagtatatctgtaccgcttaaaagcttgctgcctgttgaaacgagaaaaatttcacagcctaaaaaggcgatgaaagaaaagatcaagccgatgacaaatgaatgaatgacatagctcaattggatggtcgcccttgataaaggagctgttaaaaagtcatacgttctcttgctttctttatctttcaccataattccgaaagcgcctaaagtcgttgtcacagctgtaatggacagcaatcccgccaccatccattcgttcaccattgctttggaatcatctgtcgaaccgaccagggccttaatggcgtccagctgtgtctgctgtaagaacacggcatataacagaatgacgataaatactgacagcaaagagagaagcaaaagcgttcgatcacggaagtatatttttatatttctgctgattaaactggataaagacttcatttatgcaatgctcccctttactggcaaactgcttccttgttcttcgataatatggataaacacatcatccatatttcctttaatcacttcgaaagattcaatttttccttcaagacctttcaaaatgtcaaacgcttggagagtggactctacacgaagggaataaatagagtttttaaccgtaaaatccagttgtttattttcaaaccatgccgtcggatcaacgccttgcttaaacatcatatgcagactgtcaaacgcatattgatctttgagctgactcggtgtaccctctgcgatcaggcgtccttctttgatgaccacaacgttatcagccacagcggcctcctccatgtaatgggtcgttaaaaagatcgtcatgtttgtttcttcctgcagccttttaatcgcattccaaacaaatactctcgtttgcggatcaagacctgtagtaggctcatctaaaaataatatagtcggtttatggatgatggcacgggcaatatccgctcttcttctttgtcctcctgacaaatcgctgtattttttctccttaatatcatccaattttaaatagtctgttacaaactgatagttctcttgcacttgtgccttgcttaaatgataatattgtccgcggttcatgatattttcataaacggtcaatcgttcatccaaaatgctctcttggaaaacaactccgatctttttgcggatatgattattctctttcccctcaccaagagtataaccatctattaccacttttccggatgtctttttaatcagcgtacagagaatatcgatagtggtcgatttccctgcaccgttcgttcccagaaatgcaaacagctcgccgcgtttgacagaaaaggatacccctttcactgcttcaaatgatccatattttttgcgcagatcggttactgtaataatgtcttgttcttctcccattctgttcacctcgaaaaataagattctataccgttgttcactaactttatatcgtcattcccgccaggattttctcatttttatccaaatttattatctttttataaataattatcttgattatgaagatatacgtacataaaaaggcttcttaaaagaagccttttatcgctttacgttaatattatgctttcattccccaagtcattaacaatcgccactttgttaagaagctttgtaaggatctcctacacaaatagatttttcttttcctgcaacaacggtagaaatcctagtcgcattcgttaaaaagcctttaacagttgtcgcaaaatcttgcctccctgctttttaaaggtacaagatcatagcgtgattttttcccaattccgttttaataaataattaaaaaaggtttcatttgtgcttatatgtggctttttcttcagcaactgatgaagacttaaagaactcattctctttgtaattcatttgcatatgtttcagccttttaaaaaagtaattttctaattgtttgtctatacaataaataaaacagcctttttgtccccgggtcatcaaagttctgtatgtgttgcgaataatttcgtctgcaagcttctcagcttcttctgaattttgctttagcattttcttcaaaccacgtaaggaggtatctgttttcgcccgctttgaatgatcagtcaatactactccgtccctgcacactagatcatttcctataattacacctacataatcaaattccaaaccttggcatgtgtgtatacaacctatttcattaatagaatcttcatcaattgcccacgtgtctgagttatttaaattccaactcattccgaattgatattcaggaatctcgatatcatgaaattctgttttagctttgccttccttcacccaatcccaacagtaaccagcaactattcgagctttattattaactttattcagatcttctatctgtttacgcaattcatttggatttctatatatacgaaaatcgtagttcattccaatataattagaattcgcagtttcccgaatttgaagaacatcatctaaccagcttatataaccatctgaaccattgcaacgaaactgtgaatccagtttcatatttgtaacctgagcatctaattcttttgagaatttaaggattgtatcagtgctaccaatatcttttaatgttactctttgatgttcgtctatgaaaaaaacagaaagtttggaagcatttattatttccttaatttgattttccccaaggttattaaataaaccggatttctcatttaatcgatgcgcctcatcaacaattaaaacgtcaaattcacctgatggagcattgacataactgcccgatcctttaaataaattatcaatgtgccctttccgaaagttttgttttaacttagtagcatatatatttctgggagctgcattttttgttacatattgtgccacaagacttcggtttgttgcttctactaataaatttatagcaagaacagattttcctgtacctggtccgccttctacaattaatacttttttagtgtttgtacgtaatgcctcattcgccaaatgtaaagccgtctcatacacaactttttgattatcaatcatcataaattctcgattaccttgaagcatactgtttaacgaatcttgaagagactttgaaggccttattcttcctttatctattgtatataggatttctttgttgtctccatacttaatatactttttaatgaaatcacgaagcttacctgaatcacctttgataaaaacaggagcttcttttatataatattcatatattgaatcagttaatggatcgtctgtaccctgattcaagtagttatgtaagtatgcacaaggatatagcttgatatcttctttttgcgcattttcattgtaatcctttattaacgaagcgtatgaccaggcttgataggatgggtgggttgtttcgcgaattcctttatttataaacgttttaacgatggcctctttactatcaattttctctactttctcccattgtttaagttccacaatcacaacagatgaacgatcatccttatctgatccagatataagaaaatcaatacgctttgaagtatggggtattttgaactcaatagcaattcctgcgtccttaggaatttctctatcacttaataccctatacatatactgcatagagttatcccaagatctaacctctttctcattgattttgccaatcttatcattatagtttttacagatattcgtcaccaaattgtcgtcaaacacatcactcagaaactcttcttttgtagcttcatagactatcattgtttcaccttttcattaactttttgcgttatctctataaattcgccgctcaaaataactaaattgagctatattgagaataccatttttcttcaaattaatctgttttaatatgacctttgtacttaataattaaaaaggatccttcacatattaatataaaaagcagcgttctccaaaagagaacactgctttatttcaatactagctttgccacacactccacatgattcgtatgcgggaacatatccaccggctgcacttcgagcgtctgatacccgccatcctcaagcacccgcaggtctcttgcaagcgtgcctggattgcaggacacatacaccacccgcttcggtttcatgtcgatgattgtccgcaggagggcttcgtcgcagccttttcttggcgggtcgacgacgagcgtatcggccgtgatgccttcttcataccatttcggaatgacggtttccgcttctccgactgcgaattccgcgtttgtgatgccgttcagctcagcgttgcgtttcgcatcctcgatggcttccggcacgatttcgacgccgtacacttttttcgcctgcttcgccagaaatagagaaatggtaccgatgccgcagtaggcgtcgatgacggtttcttctccttgcagctctgcgtactcaagcgctttgtcgtagagcacttttgtctgttccgggttgacctgatagaacgatctggcggagatggcgaatttgacgtctccgatgaggtcgtagatgtattcttcgccccagatgacgtttgtttcgtccccaaaaatgacgtttgttttatttgggttgatgttttgcacgatcgatttgacgtgcgggaattgcgccgtaatgtctttgatgatcttcgctttgtgcggaaaatcgcttgttcttgtgatgaagacgatcatcatttcgcccgtgacgacgccgtatctgaccatgatgtggcgaagccagcctttgtggcgttcttcgttataggctttgacaccgtatgctgcacagatgtctttgacggcttggacggcttcatcgtttttggattgctgaatcaggcaggcgctcatgtcgatgatgtcatggcttctttgctgatagaatccggcgacgagtccgccttctctttctcctaccggcacctgcgctttgtttctgtagttccacgggtcttccatgccgagcgtcgggtgcacggtgacgtttgagaggtccagcttgccgatccgttctaagacgtctttgacttgtttctgtttaaacaagagctggccttcataggtcatgtgctgaagctggcagccgccgcattgcttgtagatcgggcacggggcatccgttctgtgcgggctttcttccttcagctcgatcaaacggccgaaagcgaagccttttttgacgcgtgtcactttaatttgcgctttttcctcaggcagggcgttcggcacgaagatcgggaagccctgaacctttgcgacgcccgctccttcatgcgtcaaatcctcaaatgtcacgtcatagtattcatttttttctatcgggggtttcattttcatctataatcacctctcgttttaccaaaagccttgtttcagcgtgctggcaaaccttcaaattcaatgtcagccttcaaaggtttccgatcacgctgaaaagatgacaaaatcctaaaacgaatactgttttaggattttgtccgcgtattagtcatccagctgttccgctttctccttcggcatgatgacgtgaatatgccggtacagattcacgaattcgcccggcagcatgccgccgtattcgccgtccaggttcagctgcatcttttctgatacattgactttcacacggttcgcttttgtgtaaataatgtgctgatcgttaatatgatcgcctctgagcgccatgctcgcgactctgataaactccgcgagattggcttttttcaaaataattaaatcaaacatgccgtcattcaggctggaatcaggggccagcttctcgaatccgccgaccgagttggtcagcgtcactaaaaacagcataatttcgccttgaaacagcttgccgtcatattcaatctcgacttctgtcggtcgaagtgaaggcaacatttccattccctttaaataataagcaagctggccgagcatcgttttcagtttgcttggcacatcgtacgtcagctccgtcagacggcctccgccggcgatgttgataaaatactgaccattcacctgtccgatgtcgatcgggcgggccacgccgttaatgacggtatcagcggcattcagtatattctctctcggaatgcccagcgctctggcgaaatcatttgtcgtgccgaccggaatgatgccgagtgtcgggcgtttgtctaacggcgcaagaccgttgacgacttcattaatcgttccgtctccgccggctgcgacaatcaggtcaaactcccgcaaagcggcttctgttgcggcgtgggtggcatcccccgcgcatgtggtggcatgggtggaggtttcataaccggcttgttcaaatttttgcaggacctgggcaagatttttcttgaaaagctcccgtcctgaagtcggattgtatattatgcgtgcacgtttcattatctcatcatcctacttaagagtatccgatccattattaacactaacaacctttaattatactatgacttgagaaaatcgcaacaatatgtacaggaattgccagaagaaaaaaggccccggctccgtttaaggagccaaggcccgctgtcttactcttcttccgttccaggttttttcttacggaatttcgctaatacttcatatacgatcggcacaatcagaagagtcagcagagtcgaactgattaaaccgccgataacggtgacaccgagtcctttagaaatgacctggcttccgccttcaaagcccaatgccaatggaagcagggcgccgattgtcgcgatcgccgtcatcagaatcggacgcaatctcgtagagccggcttccaggagcgcttctctcgtcgataggccttccgcttctttatggatgacgcggtcaattaagacaatcgcgtttgtgacgacgattccgatcagcatcagcataccgatcatggcattcagactgaccgtctctccggatacatacagtccgactaatgcgccgatgactgtaaacggaagcgagaacagaatcgcaaacggcgctaatgctccgccgaacgtgatcacaagaacgaggtatacgatggcgattgcggcaagcatcgctaacccgagtttcgtaaaggaatctgcaatatccgctgatacaccgccggtatcaatcgatacattgtccggcttatccagtttgtcaactttcttttgaacggctgatgacaccttcgtgacgttgtcagaagtgacggttgccgttacgtcagcgtacactttgccgtcgcgtttggaaatggtatcggatgtcgtgccgtttttcactttcgccacatcgccgattttcacttcttggcctgcaggtgatgtgatggttttatcctctaattcttttacactcttatactggtctttttctgttttgatgttgacgtcaagctctttgccgtcttttttcaccgttgtcaaaggagactgtgacgtttgggacatcagggcttgggagatttgcgaagccgtcaggccctgcttgctgagtttctcctggtcagcgacgaacgtgtactcatcatatgtgctggaaaggcctgagttgacgtctttcagatccttctcctttttcatgatgccttcgatgtctttgaccgtgcctttaatatcagactctgaatctccgtacacatagtacgttaattcgttgttgttgcctgacgaactgaaattttgtgatttccattcgccgcggctcgatgtttttttgatttcttttaagacattgtctttttctttgtcaaaatcaggcgtgtcatcctcgtatttcacgtagaacaatgcgccgtttgagcttccgccgagcggactttgcgatcctaaagaatactgaacagtatcgacatgtttgcgtttaagcagcatatcttccgctttttgcgcagctttttcagcttcgcttttcgtttcgcccggttcaggcgtgtatgtgagctgcatcgttttgtccgcttgcgcaggcaggtagctcgcgccgatcagaggtacgaggaacaaactgccgacaagcatcagaaccgcgatgatagatgtaatccatttatggcttaatgaccaattcagcacttttttatagaaattggccaatctgcccggcttatgctctttcgctttaacaggtgcgcctgtgagcgattttttgaataagctgtgcgcaagcatcggcaccagtgtgatcgaaatcaacagtgatgcggcaagcgcgaagacgattgttaaggcaaacggcataaacagttcgccgatctgtccgccgaccatggcaagcggcaggaatacggcaatggttacgatcgttgatgacatgatcggtttaaacatttcttttgtcgcttcacgcaccaattgcttcccgcgtaaaggttcatctttcagcctcatgcggcggtaaatgttttcgatcacgacaatcgagtcgtcgactacccgtccgatggcgaccgtcatcgcaccgagcgtcattatgttcaatgtgacatcaagctgattcagcacaagaagtgcaatcagcagtgacagcgggatggaaacgatagaaatcatcgttgatttaatatctcttaagaataagagaatgatcacgaccgcaaaaatcgcgccgaaaatcgctttgcttaacatcgtatccactgactctgtaatcggctctgccatatcaagagtcgagctgtacttgaaccctttatggtcttttttgtattgattcagttcatctttaatcgcatcggccacttctaccgtgttggcgtcattggcttttacgatattaattccgatgctgtcctttccgttcgtgcgggaaatggattcagcttttttcacatctttaatgtcggcaatgtcagagagcttgactgtcggcacccctgctgacgcgctttgctgtgcctgctgcatagcctgagcgtccgccgcagatgccgcaccggctccgcccgcttgaccttgagcggcagaagaagatgtgaccggaattctcatctctttcagatctttaattgacgtaatatttccgttaacgacaactgatttttctttgttgccgaatgtgtacaatccaagcggcgtattgacgtcagagccttggatcactttcttgacggtatcttcatcaagtccgtactctttcatttttttatctttgaaagagaattccacctgctcttcctgctgtccggaaacttgtacggacgcaacgccctgaatgccttcaagcttaggaacgagagtgttttccacatttttagtcagatcttcaagcgagcttttgccgcttgtcacactgagcgtcaaaatcgggaaagagttgagactgtaacgggaaatgtcaggttttttcgcgtcatcaggaaggctgacactgtccagcgcttcagcgacttcggttttcgccttgtccatatccttgttgtaatcatattcaatcataaccgatgagacgttttcagaggatgtggacgttacgacgctcactccttctaaattctgcaccgcctgctcgatcggttttgtcacgtcatccgcaacttgactcggagcagctccgggataagtcgtatttactgagaggtaaggcatgttgacgtccggtatggattcctgcttcatattcagaccggcatacagccctgctacagtaacgataatcgtcatcagccaaactgcgaatttgttcttcagtacaaagttaataatgtggttcatcatgtcctccgttaatttttattgactgactggtcattctatataatactaaacggtataactcaacatcgtcaactaataaggcagtaaatttttctaaatttttcaggattaaggggaagcacgtcatgaacgaaaaaaaagagaaaatcataaaaacaggcatccatttatttgccaaaaaagggttttcttcaacaaccattcaggaaatcgccggtgaatgcggaatttcaaaaggggccttctatcttcattttaaatcaaaagaagaccttttgctctcagcatgtgagtattacatcggcatgtctatggaagaaataaagaaaatcaaaacagaacatcagcataaatcgcctaaggacgtattccgaaaacaaatcgcttatcaattccaggaatttatggagcacaaggactttatcattctcttgctgagcgaaaaggtcattcctgaaaatcaaaaggtcaaacagtattttcatgaggccaatattcaatttaacatactgtaccgggatgctttgctctccgtttacagagatgccgtcataccgtttatagcggatgcgtccgttatggcgcaaggaatagtgagctcctatattcatttcttgatttttaatgaacatacggcattccggacggaaaacgtggcggcctttctgattgccagaatcgatgacctgattacgggactgataagagacaatcccgatccgctgctgccgcaggatatcttcactcagccggcggcggacagagaaagactgcttgcggatattcaaaagataaaagcacagcaggggctgcctgaggacgtcctcgtatcgcttgaagtcattgaagaggaatacgcaaaggaagagccgcgaaaaccgattattaaaggaatgctgtccaacttggcaggcagcggaaatgagcagattgaaacgctgcgggcttccattgaaacctatttcagcttataaaaaaagagaccggcgcttaccggtctccgtgtcagcagcgcccttagaggcggctgctttttttatcgttttttgatttcttcaagtaagatcttgttgaccatcggcgggttggcctgtccttttgaggctttcataatctgcccgacaaggaagccgatcgcgcggtcttttccgtttttgaagtcttcaattgactgcgggttgctgtcaagcgcatctgttaccagcttcagaagcacgctttcgtcagaaatctgcacgaggcctttttctttaacgattttttctgcgtcgccgcctttttcaattaattctttaaagactttcttcgcgattttggacgagatggttcctttttcaatcagcttaatcatgccggcaaggccttcaggagtcagtgcgacatcctcaagctctttttgttcggcattcaggtaagctgacacttcacccatcagccagtttgatgcctgcttggcttccgcgcctttattgaccgtttcttcgaagaaatcagccatttctttcgtcagcgtcagaaccattgcgtcataggccggcagaccgagctcttcgatataacgcttgcggcgctcgtccggaagctcaggaatggttgctcttacgcgttctttccattcgtcatcaatgtagagctcgacaaggtcaggctcagggaaataacgatagtcgtccgaaccttctttgacacgcatcaaaatggtttttttcgtcgcttcatcgtagcggcgcgtctcctgctgaatgactccgcctgacagaagcacctgctcttggcgtttctcttcatgctcaagtcctttttgcacgaacgcgaaggaattcaggtttttcagctccgtttttgtgccgaatttctcctggccgatcggacggagggaaatgttggcgtcacagcgcagtgaaccttcttccattttacagtcggaaacacctgtgtattggataattgatttcagcttttcgagatatgcgtaagcttcctcaggtgtgcggatatccggctcagatacaatctcgacaagcggcgtgccctggcggttgaagtcaacgagggaatagccgtcgcccgtatgcgtcagttttcccgcatcttcttcaaggtgaagacgggtaatgccgatttttttcgtttttccgccgacttcgatttcaatccagccgttttcgccgatcggcttgtcaaattgagatatttgatatgccttcgggttgtccgggtagaaatagttttttcggtcaaacttcgtatccgttgcgatttcacagttcaaagccattgcggctttcatcgcgaattcgaccgcttctttgttcaaaacgggcagcacgccgggatagccgaggtcgatgacgcttgtttgggtattcgcttccgcgccgaatggcgtcggtgagcttgagaaaattttagattttgtttttaattccacatggacttcaagtccgattaccgtttcaaagttcacttcatttcaccccttacagttcaggtttcgctttatgatgatctgttgcctgctcaaaagcatgagcgacgcggtatacagtgctctcatcgaagtgttttccgatgatttgcagtccgagcggcagtccgtccgcaaatccgcatggcacgctgattcccggcacacccgcgaggttgacagggatcgttaaaatatcgttggcgtacattgtgagcggatcgctggttttttcgccgattttgaatgccggtgtcggcgttgtcggtccgacgatgacatcgtatttctcaaatacgtcttcaaaatcttttttaataagcgtgcgcactttttgcgcttttttgtaatacgcgtcatagtagccggagctgagcgcgaaggtgccgagcatgatgcggcgctttacttcgttgccgaagccttctgagcgtgtctgtttataaaggtcgatcaggttgtccgcattgtctgagcggtagccgtagcggatgccgtcaaagcgcgcaaggtttgcagacgcttcggaagaagaaagcagataatacgttgcaagcgcgtatttgctgtgcggcagagatacttcttcccatgtcgctccgaggtcttcaagcacttttaaagcggctaaaaccgattctttcgcttctttgccgacgccttctccgagatattctttcggcacggcgatttttaagcctttaatatcgccagttaatgaagaaagaaagtccggcacttcgacattggcgctcgtagagtccattttgtccgggcctgaaatcgcctgaagcaggaatgcgttatcttctacgtttcttgtgatcggtccgatctggtcaagtgaagacgcaaaagcgaccaaaccgtaacgtgacacgcgtccgtatgtaggctttaatccgacgacgccgcagaaagaagccggctgacggatggagccgcccgtatcagatccgagtgaaaacggcacttctccggctgcaaccgcagctgcggaaccgccgcttgatccgccgggaaccgtatcgagattccaagggtttttcgtcgctttgtacgcggagttttcagtagaagaacccatcgcgaactcgtccatattcagcttcccgattgtgacggcttcagcggcttgaaggcgttccacaaccgtcgcatcgtaaatcggatcgaagttttcgaggattttgcttgagcatgttgtgcgaagccctttggtcacgatgttgtctttgacgccgatcggcattccgaagagaagaccgtgttcagaccgtccgtcaaccgcttcgtcaagttctttcgcgtaagcgcgggctctttcttcatcaagctgtaaaaacgcctgcaccttatcatccacggatgcgatccgtttgtaagattcatcaacaagatcggaaatcttgatttcttttttatgtatcatttgtttcagttctgtgattttgtgatcaaataatgacatactgtctccctcctttaatccagaatagatggcacacggacatagccgtctttatgatcgggagcatttttcatgacatcctcgaccggaaggcctttacccgcttcatcttctctcattacgtttttcattttcagcacgtgtgttgtcggttccacgttatccgtgtccacttcattaagctcctcggcaaacgagatgatgctgtcaagctgttctgtgaacatttcagcttcttcatccgtaatggcgagtctcgccaaatgagcgacatgctttacttcttctatagaaattcgtgacataagatccacctccgcataattctccgtttcgtcatataatactgatcatatcaaaaacgagccctctaaagcaacaaaacgccgccttctgaggcatgatgaaaccctctctattttatcctaaatcggggagaaagagaaacgaattatatgtcagaaaatttttacttttataatttattggtagcgctttcttctttaagctgttctaggttggcggggattttttccttgagcgggccaggtttcgagagttgattgatcggggatactttgttaggtttagtaaccatagccggcactaaatcatgcgatccccatcgaaagatgactaaaggcaggctggatcgccggcactactaatctacagaggtgatgcaacatttacatgaaagaagagagggtccaaaaacgtgagtattgaattaattatatctcttggcatttactttgccgccatgctgttaatcggctggtacgcattcagaaagacaacgaatattaatgattacatgctgggcggaagaggactcggtccgttcgtaacggcgctgtccgcaggtgcggcggatatgagcgcatggatgctgatgggagttcccggcgcaatgttcgcaacggggttatcgaccttatggctggcgctcggtttgacgatcggcgcgtattcaaattatctgctgcttgctccgaggctgcgcgcttacacggaagttgcggatgatgcgattacgattcccgattttttcgataaacgattccgccactcgtcatcattgctgaaaattgtttccgccgtgattattatgatctttttcacactgtacacatcgtccgggatggtatccggaggcaggttatttgaatcggcattcggcgccgactacaaattcggtttgtttttaacggcgggtgtagttgtgctttatacgctgtttggcggtttcctcgctgtcagtctgactgactttgtacagggagcgatcatgtttgcggcattagtgcttgtgccgatcgttgcttttacccagctcgggagcgtttcaacgacgattgattcgatcaacgccgttaacccgaaactattggatatctttaaaggcgcgagcgtcattagcattatttcttatttggcatggggactcggctattacggccagcctcatatcatcgtacgatttatggcgattaaagaagtgaaagatttaaaacccgcccgcagaatcgggatgagctggatgtttatttcagttgtcggctcattgctgaccgggattatcggggttgcgtattctcatcacttcggggtctccgtaaaagatccggaaacgattttcattattttttctaaaatcttgttccatccgctgattacgggcttcttgctgtccgcgattttagcggcgatcatgagttccatttcctcacagcttctcgtaacggcaagcgccattacggaagatttataccgcgcctttttcagacgggaagcgagcgataaagaattggtcatgaccggacgcctgtcggtattgatcgtggccgttatcgccatcctgctttccatgaatccgaacagcaccattcttgatctggtcggatatgcgtgggctggcttcggttcggctatcggccccgcgctcttgctcagtctgtactggaaacggatgaatgaatggggagcgcttgcggcgatgattaccggggccgcggccgttttaatctggattacgacagggcttgccgcttcaaccggcgtatacgaaatcattccggggttcttcctcagtctgattgccggtattgccgtcagcctgctgaccaaaaaaccggccgatgcttcttatcagctgttcagccggatggaagctcttttgaaaaacaagaaatagacaaaaagccgtcagattttatccctgacggcttttttcttccgcacttgtcctgctataaatactgtgagaaaatcatatcaatttattataagaaaaattgcggaggtgctgtgcaaattgagctggcctatcgaaccagacattttattaaagctgggcattgccacgctgatcggcatgatcatcggtcttgaacgcgaactgaaaaacaaaccgctcggactgaaaacctgtattgtcatcgccgtcagctcctgtatgctgacgatcgtcagcattaatgcagcatatcatttcccgaaatattaccgtatcatgatggatccgctccgccttcccgcccaaatcatttccggcgtcggttttatcggcgcgggcgtgatcctgcgtaaaagcaatgacgtcatatccggcctgacgacatcggctatcatctggggcgcggccgggctgggtctggctacaggcgccggcttttataaagaggcgttcgcaagcctcttgtttatcctgatcagtgtcgaatttcttccgtggctgatcagaaaaatcggtcccaatcgcttgaaggaaaaggatatccgcgtgagaatgtctctttccgataaagacaaaatgaccgagattttaaaggaaatgaaaagcaaacagctccgcattcactccgtccggattgatgacctgggtgaaaaagaatttccgattatggaagtgaaagtcagtgttcataaaaaccgctacaccactgacgtctattatgatattaaagaaattcagggcgtcgtcggagtaaaatgtgatacgttataaaaaacgccgggctggattcagccggcgtttttctatttatacgaatgcagaaaattgatactccgtaatcggtgtttcattttcgatatcgcgcctgaaggctttcagcatcccgagttcctcgtccccgagtgaattgaggtcaaacgcctgatgcaataatccgtagatcagcatatggcgcagccggaggaaatccgggatgtgttcaaaccatgcggaatcaaggtcattttcttccctgtagcctttcataaagtgagtcatgaattcacccgtaaacgcggccttgtcttcatacgggatgaccggataccacaacatgttgtacagcagaatactgatatcattcacaaaccaattgtagccgatatcatcaaaatcaaatgcagtgatttttccgttgtcccaattaaaattgccatgatgcagatcggcgtgcacaaggccgtagttttcaggattcttcggcaaacggcgcagtttttccattagagcatccgcccgctcaaatacgagatgctgatctgcgggcacgtattttctcagcttcagctgctcctcttcatcccattcctgccttttatatgccggatcgctcagacggtagcttttcgtcagccggtgcatgttccccgtgtactttccaagctggtaaaacagagttccgttccagtctgattcctccactttgcgtccgggcgctttttcatagactcttaataaaaacgctccgccttttccgtccggcacttcttcgacatctttgccatttaatgaaggaatcggctttgctactgaaagcccttcctttgccagatgatgaagccattccatttctccgagaatatattccggcgttcttctgatcgtatgcgtaatttttaagatatacggttcgttatctttcacaatttcatatacgtagttctctgcgtccgcaataaattgaaacttggtaaatccgtatatttcaccggcttcagccagcaccttatcttcctcaaaaatcgctttaatatctttatgcatgctgattcacccttttcataacatttgtaggcggtgtgtgtactcagcaaatgtcattcatcaacattcctgcccttcttttttcacagcagattcgtaacatccgcttagaaatgatatgtgttttcctgttaattcctaattatacaaatatcttaacatacctcattcctctctccaacgatattcacactaaaaaacccttgctcatacagaaatgaacaagggcatcttggttaatcgtaaatatggacggtcggttctttgtcacccgcattgcggacgatcagcgcttcctgcccgtcagacgaggtaatgttaatttcgacatcaactgagccttttgaataataatccatcagctcacctgttaagtattgggtgaaggcgatgacttcacttttcccgtaaaattgcatcgggatttcaatcttcatttttctcatttcatcgttttcgtacattgccgttccgacaactccggtgtaattcgggaagtagctgtcgatggcgtttttgaagcgtttaaacacttcggaatcatcagggtatttctttgccgtgtctgtatccgccggatagaagacgtacttttctttgacatcatcccagtttgaaatggtggatgagccggccttgacttctgttttcgcaatgtaattccccggtacgattgatgttttcggcgcttgtttataaagggcgacggtaatcggcacatttttcaggttatccattttccgaaggcggttaacgacttcctgtgcgatttcttcgccgtggctgcggatcgttttgtcgctgagctccacttcctgctgcggatcacctgtgttttcgcggtaatagtatacagagttgagagcgagaccgatcatgacaccgccaagctggatggaatttttatcttttcttactaagtaatcctgctcaagcatggacgctaagtaaatcgggctgttttcgtttttctcttttgctgatcccgagcttggcagcaccgggtttaagccgagattctggaaattggcgtctgcctttttcgcctttttcagatcactgccctcttttttgcggtcaagccagctgagaaccgtgtcctcatctaaatactggccttcctgatacaaatagtcatccgtcgggaacgtgtcttgagcgagccgcatcagcccagtctcgaattcatcgatgtccagcctcgtgttcagccggtccgcggtcaggccgcgcgcttttccggccttaaacgggagcaccattttatagtaggaatcagagatattatatttcggtatgatcgctttttcagaagactttgccgttttctgcgtgatctcttcctctttttttcccccgaaactcggcgaacaggccgacagcatgagtactgccgccgttgccgtcgccgccaatgccaacatctttttcaatagaaaacactcctcttatttctttagctctcccaatagctgtgcttcattccatacttcaatgtttaattcctgcgcttttgtcagcttgcttccggccgcttctccggcaatcagcaagtctgtttttttgctgacagatcccgtcagctttccgccgagcgcttcaatctgcgccttggcttcatttctggacagctcttcaagctttccggttaacacgatggttttgccggcaaaataagagtcgctgtcctctgcttttacttttttcgggcctttgtagagtgtgttcacaccgagttcctcaagttcattcaaaagctcaagcatttcctctttgcggaaataggtgataacggcatcggccatcttttcgccgatttcatctaccgcaagcagctcttcttccgtggcttgtttcagattttccaggctttcaaaatgcatggccagtgttttggccgcttttgagccgataaaacggatgccgagaccgaacagcaggcgttccagcgaattctctttcgacttttggatggagctgatcagattgtcagttgatttttcccccatccgctcaagccggatgacctgttctttcgtcagcttatacaaatcagcgacattacggacgagatgttcacggaaaagctgtgtgatgacacgttctccgagtccgtcaatattcatcgcgttgcgtgagacaaagtgaatcaggccttctctgatctgcgccggacattccggattgatgcagcgcagcgcgacttccccttcaatgcggacaagttcgctttcgcactcagggcagctggtcggcatattgaattctttttcttccccggtccgctgttcaattaagacattgacgacctcagggatgatgtcgcccgcttttttgacgaccactttatcgagaatgcggatatccttctctttaattaaatcttcgttatgaagggatgctcttgagaccgtcgttcccgcgacttttaccggttccagaacggcggtcggcgtaataacgcccgttcttccaacattcagttcgatatcgagcagttttgtcacgacctcttcagccgggaatttgtaagcaatcgcccagcgcgggctttttgccgtatacccgagttcttcctgctggtcgagcgaatcgactttgatgacgattccgtcaatttcataagggagatcggcccgcttcgcctgcagctcttcgatcatttcaatgacttcatctatcgtgtcgcattttttccgttcctggtttgttttaaaaccgagctcatccagaaaatccaggccctgactctgtgtttccacacccatctcgtcaagctccgctatactgtagacgaagatgtcaagatttcgtttcgctgcaattttcggatcgagctgtctgagtgagcccgcagccgcgttccggggattggcgaacggctcctcttcatgtttcagcctttcctcattgagcgcttcaaatgactgtttcggcatgtacgcctctccgcgcacttctatggaaagattacgtttcattttcagcggaatgttgcggatcgtttttaagttttcggtgatatcttcgcccgtcgttccgtctcctcttgtcgcgcctctgacgaaatagccgtcttcataacggagagaaacagcaagaccgtctattttcagctccacattgtaagcgacgccgtcaccgacagcctgacggacgcggcggtcaaaatcgcggagatcatcatcgttaaatgcgttgccgagactgagcatcggcgtgccgtgctgcaccttttgaaaagattcaagcaccgctcccccgacccgctgtgtgggcgaatcaggcgttctgagttccgggtgctcttcctctatggcaatcagctcctgcatcagtctgtcgtactcggaatccggcacgctcggttcatctaaggtgtaatattcataactgtactgatcgatggtgcggcgcaattcttctgcccggtgtttcgctgtttctttgtccatcatgttcttcctttcctcttcaggttactgcttttcaatcggcgcaaaagcggcaagcagacgcttcacgccgactgggctcgggaatgcgatatcaagctcggtgctttcgccttctccttttacgctgacaaccgttccggtgccccattttttatggcccgctttatcgccgaccgcccagctgagcgagtcgccgcctgttttgttcgcataggaaacgggacgggatacgggcccgcgtttcggctgcacttttcttcccggctgcatgcgaggtgttttcttctcatttaggttctccaataaatcgccaggtatttccctgataaagcgggattccggattcatattggtgcggccgaataaggttcgcattttggcattcgttaaatacagttcttcttccgccctcgtaatgcctacatatgcgagcctgcgttcttcttccatctcggcttcttccatcagggagcggctgtgcgggaacacgccttcttccatgcccattaagaacacgactggaaattcaagccccttagcggcgtgcagtgtcattaaagtgacggcatcctttccgcctgcttcttcttccttctggtcgagctggtcaatatccgcgatcagcgccagatcggtcagaaacgcgacgagagacttgtcttcgcttttttgttcgaagtttttcgtcacggaaagaaactcgtcgatattttcaaggcggctttgggcttcgattgatttttcggccttcagcatttctctgtattccgttttttcgagaatttcttccgtgagttccgtaatggacaggtaatcctgcatgttcgtcagattttcaatcatcgcgccaaagccgtcaagcgcgtttgccgctttcgcgctgacaccgatgaaatcaacctgtttgatcgcctggaacattgacattccgttcatcgccgcatatgaagcgattttttctagcgaagtggcgccgacgccacgcttcggcacattgacgatccgcgtaaaactgatgtcgtcgtccgggtttgacacaaggcgcaggtatgcaagaatgtctttaatttctttcctgtcgtagaacttggttccgccgacgatattgtagttcagaccggattttaaaagggtttcctcgatgacgcgcgactgggcgtttgtccggtataaaatcgcgatatcggaaagcttccgccggcccgagctgtgcagctcataaattttgcccgcgacgaattggccttcgccgaattcattgtcgccgctgtaataagaaagcttgatgccttcgtcattttccgtccacaggtttttcggcttgcggtttgagttgtttttgatcacttcgttagccgcctgcagaatccgctttgttgagcggtagttttgctcgagcagaatcacgtttgcgctcgggtaatctttttcaaaggaaaggatattcgcgatatccgccccgcgccatctgtaaatggactggtcggagtcaccgacgacgcagatattttcaagacgggccgcaagctgcttcacaaggaggtattgcgccctgttcgtatcctgatactcgtctacgtgaatgtactggaatttgcgctgataaaactcaagcacttccggcacacgctcaaaaagcttaatcgtcgtcatgattaaatcatcaaaatcgagcgattggtttttcagcagttttttctgataatcggtatacacgtcactcgtgacctgatcgtagtagccgccggccgtttttgcgaattcctcaggttcgatcagctcgtttttggcgctgctgatggagcctaaaatacttctcggatcaaactttttcggatcgatattccgctctttcaaaatccctttaataacggaaagctgatcagccgtatcaagaatggagaagtttcggttgatgccgattctgtcaatatccctgcgcagaatccgcacgcacatgctgtggaaggtggaaatccagatttcatccgcgccgggtccgagaatgctctccacccgctccttcatttctctggcggctttatttgtaaaggtaatcgccagaatgttccatggcgccacgtgtttttccgccattaagtatgcgattctgtgcgtcagcacacgtgtttttccgcttcccgcgcccgccatcagaagcagcggaccgtccgtcgtcttgaccgcttcctgctgaacgggatttaatccgcttaataattgattgctaatgtaattcatatccgttcaccgcctatcaaacatatgttctatcataaatcaatttcgtccgcttggctactttgtctttacagccgccaccgttttgagcgcctgatcaaaatcttcatatacggcatttccgacaacgatgacatcggcatgacggccgaaccgttccgccgtttccgcgtctttaatgccgcctccgtaaaacaggacggacttgtccagcacagccttcgttttctccaccgtttctatgtccgccagcatcccgctgtattccagataaaaaatcgggagatgaagcaaatgttccgcgacccgcgcataggcgagaatatcttctgtttctatatgtgtatccgcctccgtcaaagcggccgccttacaatcagggttgacgatgcagtagccctccgtcacgatttcctccattgacatgagctctccgtattctttcatcgcctgatgatgcatgccgacaatccagtccgcctttttgctgttgagcacactcggaatgaaataaagatcaaacccgggcacaatggaatcaatcgtcgacacctcaagtacgcacggcactaaaaaccgccgcacctttgacatcagtctcagcacattgtcctcggtgatattgtcgcttcctccgatcacaatggcgtcagtccctgattcacaaagccgttccagctgttcatccggtaaatctttattcggatcgagtttaaaaacatgcttccactcgttaacatcgtacatgcgttttcgttcctccattcgtttcttgccatttaaacattataacaaattcgtttggcccggaaaaacggaaaaagacgtcattcacctgattcacaaaaaaagattgcgctccgccggacgggaaacggctatgtttgaaaacagacaaaatgtggaatgtcaaagagaaaaaaggcaaggagtctgatctcaatggaacaagccattatcgtactgatttgtatattgatttttattattttagttcccgccgcattgtttctctggatttacataagagacgaaaagcaggaagaacattcagtgctgcgcaattatcccgcagcgggaaaactgcgctatatatttgaaaaaatcggacctgagctgcggcagtatttattcagcaatgataacgaagaacagccgttttcccggagagaatatgaacagacggtcatgtcgggaaagtataaaagcagaatgatgggcttcggctcagaacgggatttcgatcagccgggctattatatccgtaacgccctcttcccgaaacaaagggaggagctgcgcacagatcagacgccgaagatcgacacgatggtatacaagattgacaaagacaacctgctgaaacgcagcgaacaccgcgaaaaagcaaaagcggacccttattacctgcatccggacgatgtgcaagtgatcggccgcgacacatgcaagaaaccgttttatgtaaaagggttaatcggacaatcagcgatgagctacggctcacttggcgaccgggcaatcaccgccctgtcaaaagggctgcaccaggccggcggcacatggatgaatacaggcgaaggcggcctgtctgagtatcacttgaaaggcggcgcggatattatctgccaaatcggccccgggctgttcggcgtgcgcactgaagatggagaattttcatgggaagaatttaagaaaaaaagccgcctcgagcagattaaagcctttgaattaaagcttgcgcaaggggcgaaagctagaggcggtcatattgacggttcaaaggtgaccgaagaaattgccgccatcagaaatgtgcagcccggacaatccattgacagtccaaaccgcttcaacgagttctcaaatgttccggacatgcttgatttcattgagaaattaagaactgtcggtgaaaaaccggtcggcatcaaaattgtcccgggcagccgcaaagaccttgaagaccttatttcctgtatgagttcatcaggcaaacttcccgactttattacgattgacggcagtgaagggggaacgggagcttctttccatgagctggcggattccgtcggcctgccgattctgaccggcctcccccttgttgacggccttttgaagacatacggtataagagataggctgaaaattttcgcatccggaaagctgctcactcccgataagattgccgttgccctcgcgttaggcgcggattttgtcaatattgcccggggaatgatgttttcagtcggctgtatccgcgctcaagtatgccacaccaatcattgtcctgtcggagtggcgacaaccgatccaaaacttcagcgcgcgctcagtatcgaggataaacagcatcgcgtctgcaactacgtgctctcgttgcgtgaagggctgtttcatcttgccgcggcggcgggtatcagctcgccgattcatttctcagctgaacacatcgtataccgggaggaagacggaagcctgagggaacttcccggccttttgaatcagcacgcataaaaaaaccgcctgccgtcatcggcagagcggttttttacgtagctgaggaggattctcctttgtttacgcggtcaagcgccatttcataggcgtcgttcccgtaatttaagcagcgcttcacccgggaaatcgtcgctgtggaagcacccgtttcgctttcaattttgtgatacgtatttccttcgcggagcattctcgccacttccaaacgctgcgccagcgattggatttcattaatcgtacaaagatcgtcaaagaaacgatagcattcctccagatctttcagcgataaaatagataaaaataactggtccagttcttttccgcgtaatttatcgatttgcatcgtcaaacaccttctcctttactaatggaagctgcatcgagatcaggcacgatattaatccatgtctttcctggcacaaacggaagaatctcaccgccttttacgggcagaatacggccgtctttatattcccagtctgactccataacatcgccgtgctgaagcaggaggcccttcccccctgactgaatatcgatggcccgccttccatctttgtctgtcatgcgatggccggcttcaacaataaaaatgttgtgcatggctaaaggctttccggtctcccggtctgtcgctttcacaccatcagagcttcttgtataagcatcagcttttttatcataatcgtattcgacaagatttgtaacgttttgtgttccataatctatccgaatattgtaggtttcgtttccgggttttgcatctgatgtctgaaatgggagcggttctgtttttccgttcagcttgtatcctttttgttccgccgccttcctgatattgtcatacgacgtgtaggaattgtggggcggcttgctgaaatcggctctccaaaacaggctgccgtcaaaatccaaaccgtttatataatcgtaagttccggactccagctgctttttagcgccgggactccagccatgatggacaaatatgctgttaaacccgctgctgagcgtgacaaaatattccctcgcgctccgcacaggcccgaccgtttccggcatctcactttgaaaaatcgcgagaaaccgcgtaatccggccctccgcgagcgcttcgatgacaacatccgcctttgacagcccggattggggcctcgccttcggatgattgttcactgcgactgcaatcggacggcgttctgcaagcttctgctcagttttcagccccgttaaaggagcttccgcttctttcggctgcacctgatcggcattgttctgccggcaggcggcaagcagcaaaaacgcaaaacaaagcatacaaacggttttccatcttttcatatgtcggctccctgcttttatattttaacgcattatcgatggaaagagtacagtttttttcatcacgtcgaatattcctctcggcgtaatgcggatataaggcaggtgtgtgctctgcaaaaagagcagcgtatagatcggatcgcagaatcggtagccccgctcctccagcagcgtcctcagtttttgctctttctcaagcacttcttcataattctccgcggatgcagaaccgtttaaagcgaggggaatctcatgaagaaccttcccgttttcggcaagcacgattccgccgccgatttctttcatccgtgagaaagcgagcaggatatcttctttattttttccggcagcgataatatctccggttgtcgtgtaggaactgacaaagccctgcacccgatcggcaaaacctttcagcattgtattgacccgccattttccatgcttatcgagaagcgtgagatagcattcatcatgatcaaaagaaagctggtcaacagaattatcaatcgcaatcatatacggctccataatgacggcgttgcgcattatcacacccatcggcattgaaaactgtaaatcatccatcgtcatatcatatgaaagctcaagagggacaagaccgccctttttccaatccgtttctgtaaacgcattcatatttcggccgtcttccctcagcaggatgcctttggagatcaccgtgaccgggtccggattcatcgggtcatcgagaatgttcaatgaagcaagccggcccggaccgatcacaccgagaaagtcatccatctgataatatttcgcgatattaaaggaggccatattgtaggcgtcaatcgccggaaccccttcctccaaagcgattttgattaattcattcgtcatgccgcctttataaaaatgcggcgtcgctccatccgtcgtgtaaaagaaatgatcataatgccggaagcctttttgatggagatcctgcaaaatcgttctcaaatcagggcggatggatgaatgtctgagcgaaacatagtaacccaattcaagccgtctcatcacctcgtcgccattcatcgcctcgtggtcagaatcagccccgaacagtttcatcttcgtcagtgttttttcagaagctccgggaaaatgcccttctatccgcttgcgcagtttctttgtcgcctgcatgcaatgaagcatcaagtcatcgccgtccatgaggcgcggccatccggtcaattctccgccttgaatgacatccggatgctcaatccattgcttgcggacatcaaaagaaaggagctggtcctcattcagcacttcagtctgcagatcatatctggaccaccagaaatattgcaccggctgtttttttagttcttccaatatagtaagcgctttctttttaccgctgtgcaaaagaaaaaacaagttatcattaacaaacgtcgttgttccgaattgagacacatattcggcgagcgtttggggattatatatttgaaaaggatgtgtatgcggttcaatgtaacctggcacaatgtattttccttcacaatttatggtatgaatgtgctctgctgcatcaggaagctcatgaccaacatatacaattcggtctccgtaaatccagacgttctttttcagccattgttttaaaaaaggatttaatacgagagcatcccgtaaaagtagcgttggaagcagctttgagtctacaacatccgcctgtgatctgatgtctttatttttccagttaaaggtacgttcggacattcacatactctccttcgcttatattagacccatcgtatcacatccgcacaattatcgcacggctaaaacgttacaaattattgaagatgaatgaaaaactttttctaagggagctgaaatgatgaaaccgaatatcagtttattaaacgccgttatgcgcatcacttgcggcctcaccattttgtctgccgcttcagcaaaatacacgagaaaaccttggtgcaagatgcatctcttctgtatgatgatgggcgcgatgaaagcggcgtccggcatcctccgcttctgtccggtgacatatatgttccaagccggaatgaatcaggatgacagccatcagcaagaaaaataacaagccgtttcggcttgttatttttttctcctgtcccgcgagtatgagaagaatctgccggcgatcccggcatcacaaaagccgggacagaattcaagactgcatgacaatcttagtcgtcattcagaagaaaacccgcatcttttaagacgcgggggtttcctctttatcgctgcgatgctttcagcgcacgggcgccgatatcgcttctgtaaaacagtccgggttttgtcagccccgaaacggcgctgtacactttatccctcgccgcttcaaatgtctcagcaaatgccgtgacattggcgacccggccgccgttcgtaacaaattgtccgccgtcttttttcgttccggcatgaaaaacggcgatcccgtcttcagcggacgtcaaactgccgatcggcgtccctttcgcatagccttccggatagccttcagaagccaggacaacgctgaccgcggccgtatccttccatcttaggtcaacatctttctcatgcagaagatctaagagcacctgaatgaggtccgattccattctcggcacgacggcctgtgtttccggatctccgaagcgcgcgttgaattcaatgacctttgatccgtcttccgtcagaatcagccccgcgtacagcacgcccgtgaaggagcgcccctctttcaccattgcttttgccgccggcttcacaatcgtttcgactgcgcttctgacgatatcatcggaaatgtgcggcaccggtgagtaggctcccattccgcccgtattcggccctttgtctccatcgaaggcgcgtttatgatcttgagcgatgaccatcggatagacggtctccccttttacaaacgccattaaagaaaattcttcgccggcgagaaactcttcaatgacaacagatgcgctcgcctccccgaatttctcatcctcaagaaaatcgtgcaggcattcaatcgcttcttcttccgtcatcgcgactgtgacaccttttccggcggcaagcccgtccgctttaatgacaatcggcgcgcctttttgctgtacatatgctttcgcctcttcaaatgaagtaaacgtctcgtactccgccgtcggaatgccgtattttttcattaaatccttggcaaactgtttgcttccttcaataatagccgctttttcagacggtccgaaaacaagcagtccggctttttcaaactcgtcggctatcccttcaatcagaggaacttcggggccgataatcgtcaggccgacatgatgttctttcgcaaacgcaatgagtgcggcatgatcgctttctccaatgttgaccagcgtcgcgcagtctgtcataccgtcatttccgggcgcggcgtacaccgtgtcaacaagcgggctttgcgccgctttccaagccaatgtatgctctctgccgccttttccgataatcaatacattcacgcttcgttccccccttaatgtttgaaatgtctgatgccggtgaataccatggcgattccgtattcatccgctttcttaatcgaatcttcatcgcggaccgatccgccgggctggataatcgccgtgacaccggcttttgcggcttcttcgactgtatccggcatcgggaaaaacgcgtctgatccgagcgcgctgccttttgctttttctccggcctgctcaatggcgattttggctgaaccgacgcgattcatctgtcctgcgcccacaccgaccgtcatatggtcttttgcaaggacgatcgcgttggatttcacatgtttgacgactttccaggccagcttcaaatcttcccattcctgctcgctcggctctctttttgtcgggatggtgatgtcggcgtcatcaaatccatggacgtctaaatcttgaatcaaaagaccgccctgtacggaagtcagctgtttttctttctttcctgatgcggtcacgtcaagcgtgagcagacgaaggtttttcttcgccgtcagcacgttcagcgcttcttcactgaaagaaggggcgataatgatttctaaaaagatgccgtgaagggcttcagccgttgcctgatcaacttcacggttcagcgcgatgatgccgccgaaaatggaggttttatcagcttcatacgctttattgaatgcttcctcaattgaagctcccgtaccgactccgcatggattcatatgtttaacggcaacagctgcgggttctgtaaattcccggacgatttgaacagccgcatccgcgtccttaatattgttataagaaagctctttgccgtgaagctgttttgccgctgcgatggaaccggagacaggaagtgcgctttggtagaaaaccgcctcttggtgagggttttcaccgtagcggagcgactgttttttctcaaaagtaacagtgaattgctcagggtctttctcaccggcctcgcgtgttaagtaatcagcgattaatgcgtcgtatgccgcggtatggcggaatactttggccgcaagctcgcgttttcttttgagcgaaacgccgccgtgttctttcatctcattgagcacggagctgtaatcggccggatctgtgatgaccgtcacatcctgatggtttttcgatgcggcgcgcagcatgccgggaccgccgatatcaatgttttctatcgcttcatcgtatgttacgtcttcttttgaaatcgtttctttaaacggataaaggttgacgaccacaaggtcaatcggtgcaatgccgtgttcattgatctgcgccatatgctctttattgtctcttacggcaagcagaccgccgtgaatattaggatggagtgtttttaaccgtccgtccataatttcaggaaatccggtcacttctgaaatgccgatgacatccacaccgttttcctgaagaagtttttttgttcctccggtcgaaatgacttcgacgccgagctctgtcagttcctttacgaaaggtacgagatttgttttatcagaaacactgattagtgcgcgtttgattgtcatgccttttcacctctgttatttagtcccagcagccgtttcacaacgctcggataccatttgtgctcaagctcgtgtattgtatgctctatgtcttcaagcgtatcgttttcctgtatttcgaatgctttttgcgcgataatcggtccggtgtccatgccttcgtcgacgtaatgaacggtaatgcccgccactttcacaccggcccgatacgcctgtccgacagcgtcaatcccagggaatgccggaagaagcgagggatgtatattaataatgcgtcctccgtatgcttcaagcagcgtatctccaatcagtctcatatagccggcgagaacgattaattccgccccgtgcaggcgcagctgttcaataatggcccgttcaaaggccgctttgttttcaaaagatgacggttcaaaggcgaatgacgggatatgtaaagcctccgccctttccgccgcctttgcctgaggcttatccgtcacgagaagcgagagctccgcatcccacttctcttctctcatgcgtttggcaatggcctcgaagttcgatccgtttcctgaagcaaataccgcaaactttttcatgaaagagccgcaccgccgaaagaaatgccttcgccccgcttgacccggccgatcagataagccttctcgccctgagcttcaagcgtgccgatgacgtctgtcaggttttcttctttaacggcaaggacaaaaccgatgcccatattaaagacattgaacatttcttcttctttcagcttgccgtgctcctgcagaaacggaaaaatcggcgggatcggccatgatccgtgatcaatttccgcgctcaatccgtccggcagcatccgcgggatattctcgatgaatcctccgcctgtcacatgcgccatgccgtccaccttaccgcttttcaccgccttgagcaccggcttcacatatattctcgtcggttccagcaattcttcgccgagaggacgcgcaaacggttcatagacagtatccaaatcaagtccgccgtcatcaagaagcacttttctcaccagggaaaatccgttgctgtgaaggccgcttgaagtaagtccgattaagagatgcccctcttcgatatgttcaccggtgacgatttcgtctttttccgcgacgccgactgaaaagcccgcaatatcgtattcatcagacgtatacagccccggcatttccgccgtctcaccgccgataagcgctgatcctgactgctcgcatccgtccgccacaccctgaacgatctgctcaattttcaccggatcagccttgccgaccgccaaataatcaaggaaaaacagcggctccgctccctgggcaagcacatcgtttacacacatcgcgaccgcatcgacgccgatcgtgtcatgcttatccattgaaaatgcgagtttcagtttggtgccgacaccgtctgttccggaaattaaaacaggcttttgatacggaagctctgacagatcaaacattccgccaaaaccgcccaggcttcccataacgccgagccttttcgtgcgctccacgtgttttttcattcgtttgacggcttcgtatccggcttcgatgtcaactccggcatttttataagcatcagacatccctatcactccttgtcaattcgtttctcctaaaaaggcagaaagagaaaggcagcctgaattcccgctgcctttatgtcattttcacattttattttgtcagcaccgcttcttttacgtgaggaagcactgtatcctgataaatttccgtcggatatttgcccgtaaaacaagcgaggcattgtccgcaattggtgtcttcaaattttcggccgactccttttaacaatccgtctacacttaagaaagaaagcgtgtcggcaccgatgatctgacggatttcttccacggaatgagaagaagcgatcagctcctcatgggttgatgtgtcgataccgtagaagcacggatgagcgatcggcggtgaactgatcttgacgtgcacctctgtcgcccccgcttctctgagcattgtgacaatccggcggcttgtcgtcccgcgcacgatggaatcatcaaccatgacgacccgttttccttcgacaacaccgcggacggcggacagcttcattctgacgccttgctcacggagagcctgtgacggctggataaacgttctgccgacataacggtttttaatgagaccgagttcatacgggatgcccgtcgcctcggcatagccgatggccgcagaaatactggaatcaggcacgcctgtgacgacatccgcttcaaccgcggactcccgggcaagcattttcccgaggtttttccgggcgctgtgcacgttaatgccgtcgatattgctgtcaggtcttgagaaataaatgtactccatgctgcagatggaacggttgatattcatggaaaaacgctctgatttcaagccttcatcgttgatgatcagcatttcgcccggctctacctcacgaaggtacgttgcgccgacaacatcaaatgcgcacgtttctgaagcgaccacataagcatcgcccatgatgccgattgacagcggtctgagtccgttcgggtcaagcgctacgatcatctctgtttcagtcatgattaaaaaggcataagcgcctttcagcatagatagcgaatttttgatttgatccttcagcgaaaagtgtccgctgcgtttaatcagatgagccagcacttccgtatcggaggaagtctgaaaaatgctcccttggttttcaagctgctgcttcagctgtgtggcgttgaccaggtttccgttatgggcgagcgcgaggctgccgttgttttgcgaacggaacaggagcggctgaacattttcatatccgcctcctccagccgttgcgtaacgaacatgcccgatcgcgccttttccctttactttgctgagctcgccgttttgaaatacttcagtgatcagcccttggcctttgtgcgccgtcagtttttcgccgtcagtcgcgacaattcccgcgccttcctgtcctctgtgctggaggctgtggagaccgtaatacgtaatttgcggggcttcttcatgtccccagatgccaaacacaccgcattcttcattcaggcctttgatttcagcaagcatggaatagctcctttccacgcgcgctcaagttctttcgtttgcgcgtgaaccaattgttgtccgtcctggttttgaatcgccagaagtccgtcagccgttacctcaccgatatgaaccgcatcagccgcagccgcttcaaacgccgcttggtgttcttttttgaccgaaacgacgaagcgggattgagattcagagaataataatgccgcttccccttcaacagtcacgttggcgccaaggttttccgtcgtcatgacactttctgcaatcgctacgcctaagccgccttcagatacgtcatgcgcggattgaacgaagccttttttaatcgcgtcaagcaatgctttttggcgtgacagctctatatcaagatcgatttgcggcgctttgccgtaaatgcggccttctgtcattttttgcagttcgcttccggcaaactcaggttttgtttcgccgatcacgtatacaagatcccccgcttgtttgaaatgctgtgtcgtaatatgagcggtatcttcaattaagccgaccatgccgataacaggcgtcgggtagatagccgttccgttcgattcattataaagtgatacgttaccgccgatgacgggtgtgctgagaacattgcacgcctcgctgatgccgtcggccgctttttcgatctgccagaaaatttcaggtttttccgggtttccgaaattcagattatccgtgaccgcaagcggttcggcgccggagcatacgatgttgcgcgccgcttcggcaacggcgatttttccgccttcttctggatcaagatataaataacgggcgttgcaatccgtcgtcatcgccagcgcttttttcgtgccgcggattctgagcactcccgcgtcagagcccggagcgaccaccgtatttgtgcgcaccatgtagtcatattgatcatacacccactctttgctggcaattgtcggctgctgcagcagggcaaaaagcgtctctgtcccatcttttacttcaggcgcgggaacttctgtttcctgaaactcgcggtagtacgcgggttctgctgacggtttgtggtatacaggcgcttcttccgccagtgcgtcgaccggaagttcgcaaacaacctctccgttatggcggaggcggagcattttatcatccgtcacatgacctacggaaaccgcttcaaggtcatatttatcaaaaatatcgacaatttcctgttcacgtccgcgttcaatgacgagaagcatgcgttcctgagactcggaaagcatcatttcgtaagcggtcatacccgtttcccgctgcggaatgagatcaaggttcatttcaatgccggagccggctttgcttgccatttcagcactcgaacttgtcagaccggccgcccccatatcctgaatgccgactaaggcgtcgcattggatgacttcaaggcatgcttccaggagaagtttttccatgaaaggatcgccgacctgcaccgcggaacgtttttcttcagatgaatctgacatttcttctgatgcgaaagtagcgccgtgtatgccgtcgcggcccgttttagcgccgacgtacatgaccgtgttgccgacacctttcgcctggccttttttaatatctttatgatcaatcaagccgacgcacattgcattgacaagcggattgccctcatagcttgcgtcaaactgcacttctccgccgaccgtcgggatgccgatacagtttccgtatcccgcgattcccgccactacttcttcaaacaagtacttcacacgaggtgaagtgagttcaccaaatcgaagagagtttaatacagctatcggacgggcgcccattgagaaaacgtcacggataatgccgcccactcccgtcgcagcaccttggtatggctcaagcgctgacgggtggttatgagattcaattttgaacacgaccgcctgattgtcaccgatgtcaacgattcccgcgccttctccgggaccctgcagcacgcgttcgccgctagtcgggaatttgcgtaaaaccggttttgagtttttatagctgcagtgctctgaccacatcacggaaaaaatcccgatttccgtgtagttcggcaatcttccgataatagattcaatgagtgcgaactcgtcatcactgacacccatttgctgatagagtttctcttcttttatttgttctttacttggttcaagcagtagcgacatgagtttccctccaatttttcacgatagaccggaacaatgtaagaccgtctgcgctgccgagcagttcatcgactgcgcgctcagggtgaggcatcatgcctaatacgttgcctttctcattcacgacgccggcaatgccgctgacgcttccgttaatatcgccgccgtatgtgaagacgatttgattgttttcttttaatctttcaagcgtttcgtcatcacagtagaaattgccttcgccgtgggcaaccggaatcgtaatcgattgtcctttttcataggaagatgtgaataacgtatcgccgttctgtacgattaattcaaccgggcggcagatgaactttaaatctttgttgcgtctcatggcgccgggcagaagtccgagctcctgcagaatctggaatccgttgcagacgccgagaaccggttttccttcggcagccgcttttttcacggccggcatgatgtttgcgaatctggcgatggcgccgcatctcaagtagtcgccgtatgaaaacccgccggggatgagcacgccgtcaaatccgtcaaggcttgtttcctcgtgccagacatactcgacttcttcgccgagttcgtcctttacggcgtgaaacatatcaatatcacagttggagccgggtaacacaatcaccgcaaatttcactgtgcgacaacctcctcaacttcatatcggtagtcttcaatgactgtattggcaaggagcttttcacacatttctttcacgagcgcgtcaagatcgcggtcagatttttcgatcgtcagctccatgtattttccgatgcgcacatcctgcacttcattgtaggtcatgctgtgcaatgcatgctgcactgcgcttccttgaggatcgagcacactttcttttaagctgacataaactttcactttatacattatgaaatgcctcccagtcttttgaaaatctcttcgtatgcgtcggttaagctccccaggttccgtctgaacaaatctttatcgagcttttcgtttgtgtctttgtcccacagacggcacgtgtcaggagaaatttcatccgctaaaagcacccgtccctctgcgtctaagccgaattccagcttaaaatctattaatctgaccccgcagtcttcaaaaatatgctgaagttcttgattcacctggtttgtaatcgatttgatcgtttcgacatgctcaggagccgccgcttttaagagccggatatgatcttctgtgatgagcggatcgccgagtgcgtcatccttgtagtaaaattcgataatcggctgcgggagctctgttccttccgggatgccgagacgtttcgacatgcttccggcggcaatgtttctgaccacgacttcaagcggaatgatgctcacttttttgatgagctgctctgattctgaaacacgctccacaaagtggttgtcaattcctttggcgtgcagatgtttgaaaatcaggcttgaaatttcattgttcagacggccctttccgctgatctccgcttttttctcaccgttaaaggctgttgcggaatccttgtagaccacgcggagaatctgttcgtcttcagtttgataaattcgcttcgcttttccttcataaagaagattattgttcacaatattcacggaaggcctcctaacccgaatgttgggaatattcaatctacggcggctgaagaagccgcctccggctggcttcttctataaacctaaacgctcaaagatcaagtcgacgtttttcagatgataattgtagtcaaagcaatcggcaatctgttccggtgtgaggcgggacgtgattttttcctccgcttcgacaagctggcggaacggcacttgtttttcccacgcttccatcgctttcggctgaaccgtgtcatatgcttcttcacgaggcagacccgtgtcgattaaagcaagcagcacgcgctgagaatagattaaaccgagtgtgcggtccatgttgcgtttcatattttccgggaataccgttaagtttttgacgatgttgctgaatcggttcagcatgtaattcagcgcgattgtcgcgtcaggaagaatgatgcgctcagctgatgaatgagaaatatcacgctcatgccataacggtacattttcgtatgccgtcagcatgtacccgcggatcacgcgcgccatgcccgtcatattttccgacccgatcggattccgtttatgaggcatagccgatgagcctttttgtcctttagcaaaaaactcttccacttcacgtgtttcactcttttggagaccgcggatttccactgcgaatttttcaatgctcgtcgcgatcaaagccagtgccgccatgtaatccgcatgacggtcgcgctgtaatgtctgagtggaaatcggcgccgctttcagcccgagtttttcacagacatactgctctacgaacggatcaatatttgcatatgtgccgaccgcgccggaaagcttgccgacttcgatcccttcttttgcctgcttgaaacgttcaaggttgcgtttcatttcttcgtgccaaagcgcgagcttcaggccgaaagtcgtcggttccgcgtgtacgccgtgcgtgcggcccatcatgaccgtgtatttatgttctttcgctttttcttttataatgtcaacaaatctctcaatgtccttgagcaagatctcattcgcctgttttaatagataggaaagagcggtatccacgacatctgttgacgtcaggccgtagtggacccattttctttcttcgcctaatgattctgaaaccgcgcgggtaaatgcaacgacgtcatggcgcgtatcctgctcgatttccaaaatccggttgatgtcaaaagacgcgttttcgcgcatgaccttgacgtcttctttcggaatgacgccaagctcagcccaggcttcacaggctaaaatctcgacttccagccatgcctggtatctgttttcgtccgtccagatcgcggacatttcaggtcttgaataacgttcgatcattatgctcgtcctccgtctcttttcatccatatgttcgtgatgtcctgaatccatgtttcatcaggcttccgcaaaaatgtcatatgccccattttgcgcccttttttaatctcatgttttccgtacaggtacagtttggcttcttttaaaagctccgtatgctcctccgcaagcttcacttcctcaccgagcagattcaccatcattcccggtttgagaagatcggttctgccgagaggaagtccgcagaccgctctgatgtgctgttcgaattggctcgtttcacaaaggtcgagcgtataatgcccggagttgtgaggacgcggcgccagttcattgatcaaaaggtctccgtcttctgtgacgaacatttccaccgcaagcggcccgacaagctccaatttctccgcgagctggacggcaagcgcctctgcccgcttttgaaccgtttcctccgctctcgcgggcacgatgctttggaacagaatattatttttgtggatattttcagcagccggaaaggttgaaatctcaccgtgcaccgatctcgtcacgataacggaaagctccatccggaacgatacccagctttccagtatgcacgtgccgttttctagcagcgcggccgcttcgtctgtctgtccttcttccttaatgacaaattggcctttgccgtcatatccgccgcggcatgttttcagcaccgccgggagccccagtgcctgaacagcttcctcaagctcccgtccgctgtttacgatccgataaggagcgacttgacagcctgctgactggatcgcctttttttccgtttccctgttttgggtgataagcagcagctcgcttccctggggaagatatgcatgttctttgagccagttgagcgcctcgtaatcgatattttcaaattcgtacgtaatgatgtcactgactccggccaatttttgaatcgcttcacggtcattgtactgggcggtaatctcaatatcggcgatctgtccgcatggcgagtctttcacgggatcgacgactgcgactttatagcccatctgttttgcggcgacagccatcatttttccgagctgtccgcctccgataatgccgatgacggcgccgggataaatcgtttttttatcagacaagctgatcactgctttccagcaccgtttgttttgtcgcatttcttctcgcctctagtttatccgcaatgtcaccgtcaaatgccgacaaaatctgcgcggctaacagacccgcgttcactgcgcccgcttttccgatcgccgttgtcgcgaccggcacgccgccgggcatctgtacgatagacagaagagaatcaagcccgttaagcgattttgtctgaaccggtacgccgatcaccggcagtgtcgttttggccgccgtcatacccggcagatgcgccgctccaccggctccggcaataatgacttttaagcctctgtctctggcgctttctgcatattcaaacatcaaatcaggcgtccgatgcgcggatactacctgtttttcataaggaatgtgaagttcgtcaagtatgtcgcatgcatgtttcattgtctcccaatcggaggtgcttcccatgatgattcctgctagcggctgcattctgttcccaccttctcatgctttgtttttcagaaaaaaaagcccggcttatattgcaactatgaggaagcaatacaaaccgggcatggcgcgcgtatcgtcagtcgttcgcttctgcgatatccatgtcagctgtttatcactttcctgcatagtccggccgtttacggcagccgggtagaaacttatgggccatattcccaagattatatgaggtcgtgttttgatttcatgtttatcttaacaacggacttggataatgtcaacgacattatcgaacgatataaaaattctttcttttaatgttcgtgtttagatcaatttcccttcaaatacgatttttttcccgcaaggaacgacttgaattgatccattttctttcttttctgtaaagatcggctcttccatccgccggacgggcatataaccctcttccttcattaaagtgagaatggtgtcaatcgtttcatgttccgttacttcaaaccgtttcttttttggctttgtcattccttaattctcctcttcttcactgctttcacccagaatccgccgtggatcgttttcggctcaaaggcgatgataaacgctttttcatcaagcgttttaatcgtatcatacagctgaagctcatatttgcgcggcgtcagaatctgcatggcggtccggtctccttcaagtccgcccgcaacccagcttgtaacaccgtatcctttttcccggagctgtttcggcaggtccagatcgagctccttcgtaatgacgttgactgttatgtagccgagcgccagtttttcttcaattttcattcccactatgacgccgaggccgtagccgagcgcataggcaatgacgttttgaatttgattcagattgtcgagcacaagactcaggccggtcacatacacaaggatttcaattgtactgatgcctgcggcgaaatagcgctgtccctttaatgtcagaatcatcctgatcgtaaagaaagagacatatataatgttaatgatgagaataatgagaaccatacctatactgttggataaaattgtctgcatcactgattcccctcctctgactttgaaaagccaatctttcaattaaggatagtttaccctcttttcatcattttcaaaagaaaaaaaagcccgccccgcaaggcagactctcaagctcttatcagtgaagctcggcttttttcaatcgtttgacggcttcatattccttctcaagttcactcagcgtgtacccggacagttcctgaacatggtcttgataaaaccctgagcggatcagttttgtcctcaggtgctgttttttccgattaatggcttctcgcaacaacggggccatcttcatcatccctttccgaatcataaagagtagtgccgctttcgaattgctgttgctctcatcatatctcggccgggtcctcaaaacaacacgcttcattagaaaaatttgtaaacattgtgaaagacaaatttcgacttataaaggaatcagcgaagcagtaaagtactcggaaatgagcggccatgtcacagccgtaaaaacgagcatgatgatgaccgccgcggaaatacagtacatcacgtcagccgcaggcttttcagccgatttgtatagaatctgcacaaactgcaccatcgccgaggcggccagaaacaaggtcagcgccgtaaacaccacggtgatgaccggcagattcaatatcgcgaaaatcatccacacgatagagcaggcgacagccggaaccaaaagcgatccgacccccgcggccgcatcccgcatcgtaattttctgcttcatcatataacgtgatacaagccagaccgcgccggccgcagcggcaaaaaagacgagcgtatacacgagaacgacggtaaagccgtcaaaaaacgtatgatgccgctccccgtatccgagaggcctttgctggcttgccctcagctgaaaccaatttccgattgagaaaaagatactgaatacaagcattgaaataagagcatatttaaagcgggaaaagccgtcttccccaacgaccttcaccggtgatgtcaaaatgcgcagcgcgaaacggcaataacgtttgaccgcggcccatgcagaagcgagtttttccgtaaaagccggagccgggcgccgttccttttcttttttcttttgcttttgataacgtcccgcatttctggacattctcgacagcggttcttcatcagttccctgatgctgtttttcttcttccaacgtttcttttctttcttccgtcatgtcagcaactcctatcaaaaaaatacggcggaatttgtttagcaagaaaataaaacacttatataaggtaccgaagcggccttaaacagtcaagcggttttcttcacccggacacccacatgacgttttatattatgtattggttttacggaataggacaaaaacaaaaaaccggctttccccagccggtttttccgttatttcaagaagatgaaatacaggataaagatgacgaacagcccgtacataatcgggtgaacgctttttccttttcctttgcagatcattgtaatcgggtagaaaataaaaccgatcgcaatccccgtcgcaatactgtacgtcagcggcatcataatcatcgttaaaaatgccggaacagccacctcgaatttatcccaggcgatcttaccgagcggcgccaccatcagcgcgccgacgataattaaagccggagccgtcacattcgtggtgacaactgacagaagcggcgagaaaaacatcgccagcaaaaagagaatgcccgtcacaacagccgcgaagccggagcgcgcccccgccgcaacgcctgagctggattcaacataagaagtcgttgtagacgtaccgagcacggctccgataacgattgatgttgaatccgccaaaagcgctcttcccgcacgcggaagtttgttttccttcatcagcccggcctgtgtcgctacagctaccagcgtaccggccgtatcgaaaaatccgacgaacaggaaagttaaaatgacaatcagcatttgtacggagaagatatccggaaggtgcatccacgcctgtccgaaagtcggcgcaagactcggcacgctgccgacaatgtgtgtcggaaccggaatcagcccgcagatcataccggcaaccgccgtcaaaagcattccgataaacacgccgccgtttacgcgaagcaccatcagaatgaccgtcacaataacaccgaaaaccgtcagcagcacagggccgctgtgaatattgccgatagacaccaaagtcgatgagttcgcttcaataatgcccgaaccctgcaaaccgacaaatgtgataaacaaaccgatacccgcgccgaccgccaatttcagctcaggcggaatcgcattaatgattttttcccgcaatcccgtcagtgaaagcgccacgaagataattccggaaatcaagacgccggaaagcgcagcctgccatgaaatccccatgccgagtacgacagagaaggcaaaaaacgcatttaatcccatacccggcgcaatcgcgatcggatactttgcaataagccccattaaaatacagccggccgcagatgccaaggctgtagcggtgaacaccgcgccctgatcaatttttaatgcttcgggaaatcctttcacaccgtttaaagacaatgtcagcggattgacgaacagaatgtacgccattgacaaaaaggtcgttaaaccgccgatgatttcattacgatagcttgtccccagctcatcaaactgaaaaaattgcttcaagccaattgcctccttcattctctcccatttattctgcccgttatccgccaaataaaaaacgccccaaatacatttgggacgcttgactacatacgttcagtctgaataaataagaatggattatttatatcaaacgattgagattgatccgtagtcaagccatttacggtagcttggtagaaacttgcgggccatatccccgccattatacgatatctgcatatttgatttctgagtctattgtatcaattcaattttgaaaactcaataaaaaaacgaacaatccagttaaaaaaaattggtttattcgttaattgaccaaaaatggaagacggcaagggccgccttcccggcatcattttccgttcgcaggccgaaccggcaccgcgaatgtgatccccttgtcatccgccagcaagttcataaccgtttgattgacgtacaaagcatatgaatcgaatgagaaatcgcgcaatgaatagtctttatcggatgaatcatctaattcaaaaacggattccatttcaccctttttaagattcgtgactttcgccttattccctttcagataatagcctttttcatactcattaagcgatggccaagttttcatttttttcgtattgccgagaccgattgattcaccgacattcatcagctgatctttatccgctttgctgtaattaattcctgtgaattgataatcgacgatcacccgtctgtcttgctgtttgatctttttgatggtaatgccgacatgatgatgtttcgttttataactgacgggcagttttgttttcagaggcacgatttctcccggctctgattctgtttttatatcacccgttatgaaaagtgttttcgctttcgggtctatcggtttgctgaattgagtttggccgcgtattcttttcccgccgccgggaagattcttcctgccgccaagttcaatattcgacatcgtcatttcataatggtttccagcatcatccgttgcttcgtcaatcgagatggcatcatttttggctgcatcatagaagtcgatagaatacaggagagccgatcccatcgttccgttttccgcccggatatcgaaaaagcggtataatccgtgatttacattcacagctttcgttccttcaagagaaacggacttttgttttttaatagggagtgtaaagcgccagtttccggggatatccttgatttgtgtaatgacaagcggaagcttatcaccgtctttcagctttgagccgtccgtgaacaggcgaagctgccccgcgtaccgcccgtctttcatttttttcatatcactgctgtcataatcctctgctaacatattccgtggatctttataatcgacttgaaaagagatgctctcctcatctgatttcaaattatcaacgataaagttataaacgagctgtccgctgtcgtaatacacacttttcactgtcaccgtgattccgcgtgattccgctttttcgttcagttttgtcaccaaattgcttttaaacagcgcagaacctgccttatcctgaaacagactgtaaatttgtccggcaacaggaatgtttcccatagcggtgttaacggagggcatgaacaagcctgaggacagatacagaataaacagagcagcagcaaccgcgaggccgtttatcacttttcgtccccatctccgtctgacggcgccttcttttccggcacggacagcagcgctgtgtatcacgtttttcaactcagctttcggcacgtcaatgtcctgatacaattgcttcatttgatgcttttccatatgtgtttatcctccttttccagttcctgcttcaatgcttttctcgccctgtagagatgcgtttttacagtgccttccgccataccggtctgttcagcgatcataccaatcgagaaatcttgaaaataataaagctgaatggtcagctgtatatgttcgtcaagcgtttccagagcattccgaagatctatgtattcttcaatattcttattctccgcgcgcgtatcgtgctgcggctcaaacggaatgacgtctccgtgctttttcctcatcgcaaaaatcgtatgaagcagaatccggatcagccacgttttaaaatatttcggctccttcagctgtgcgatatgaagaaaagccttgtaagccgtttcctgaacagcgtccagtgtatcttccttgtgatgcaaataaagataagctgttttatataaagtctcctgatgggttgtgatcagtttttcaaaggctgcggcatcaccttttttcgcctttttgatcaatcgttcttccttcaccttatccacctcctatgctgttagatatgaatcggggcaaaacggtttcaaaaagatgaaaaaaaacgcctcttttttaaaagagacgttttttatcttcatttattcccactcaatcgttgcaggcggcttgctcgtaatgtcatacacgacgcggttgatgtgtttcacttcgttgacgatccgtgttgaaatcacttcaagcacatcccaagggatacgcgcccagtcagatgtcatgccgtcaattgatgttacggcacggataccgattgtgtaatcatacgttctcgcatctcccatgacgccgacgctgcggatgtcaggaagaaccgtgaagtactgccagatgtcgcgctcaaggccgtggttcgccacttcttcacgcagaatcgcgtctgattcacgaacgatttcaagtttttcttccgttacttcaccgagtacgcggatgccaagtccagggcccgggaacggctgacgccatacgatatcatccggaaggccgagctctgtgccaagcgcgcgcacttcgtctttgaaaagggtgttcagcggctcgatcagttcaaactgcatatcttcaggaagtccgccgacattgtgatgcgatttgatcgtttgcgccgttgcagtaccgctctcgataatatccgtgtaaagcgttccttgcgcaaggtaatcgatgcctttcagcttgtccgcttcatcatcaaatacgtaaatgaattcgttgccgatgattttgcgtttttgctcaggatcagaaacacctttcagcttgtttaagaatctgtctttcgcatcaactttaatgacattcatattaaagccttcgctgaacgttttcatgacgccttcagcttcgcctttacgaagcaggccgtgatcgacgaaaatacaagtcagctggtcgccgatcgctttatgaattaaagcagccacaacagaggaatcaacaccgccgcttagcgcgcaaagaacctgcttgtctccgactgtttcgcggattttttgcatttcgatttcgataaagttttccattgaccattcgcctttacattcacaaggcccgaagacaaagtttttcagaaggtcatttccgtattctgaatgacggacttccggatggaactgcacaccgtaccattttttgtcttttttgctcatcgccgagttcgggcagtgatggctcgtcgcgtctaccgtaaatccttccggcacttgtacgactaagtcgccgtggctcatccagacaacttgttcttccggaagatccttgaacaagtctggagttccttgaatctgaatgttcgcttttccgtattcgcgctggcttgccgcctcgactttccctccgaggtaatgagtcatcagctgcatgccgtagcagatgcccaatacaggaatatcgagttcaaagattttttcatcacagcggaaagatccttcatcatatacactgttcggtccgcctgaaaggataattccttttggattcatttctttgatttcctcagctgtcaacgtatggggatgcagctcgctatatacgccaaattcacggatccggcgggtaatcagctggttatactgactgccgaaatcaagaacaagaatcatttcattcactaacttcgtcatggttgtcacctaatctcctctaagtttttgacacagaaaaaacggaggacacacgttcagccctctgtcggcaagacttgtccggaagcccggctttttaacgctcccgggctcccatttaacattcatatattctaacaacaggacgatatgcggtcaagactatcttcttttaattatattttcccacaactgtcccgattcattccaaagctttgcggcattatcgctgcggtataaagcacgctcatagcgcagcgtcagctcggacatgtcgtttgtatggtgcgcctcatcaacccttgcggcaaaatcgcggagcgtttctccgtctcccctgctgaacccttttcgtttcagctggcggagcagcgcggcatatgcgtcgaaaaagacgtcttcatccgttcgccgcttcaatccggctgctgtaacgtgcggaatccagcgcacccggaacagccaggcgagtgccgccgcggctgaaattacgatgacgatggctgcatacggccacaggtgtgccgcggttttgttgcggatcacaggctgcggtgccgcgctgtgatcccgctttttcggtgtttcttctttttccggctttgtttcctgacgctgcttgtcagacggtgaatccgaattccccgctgagcctccgctgtcttttgccgcggtatgattttgctctgacgtaaactccgtcggattggtgaagccttttgtcggctcaaacgtcacccagccctgatcgggaaaatacacttctacccacgaatgggcgttgttgtttgtgacttcataaatgtggccgttatggtcgcctgcccctttatattcaccggatgtatagcccttcacccagcgggcgggaattcccgcagagcggagcagcacggccattgccgatgaaaagttatcacaatatcctcttttcgtttcaaacagaaattgatcgacataatcctgattgtgctccggaaccgcgacatcctgtgtattatacgaaaatgcggaagatccgagataatcctcgatcgccttcgctttatcgaacatattatgatgatcccgcgtcaatctgtccgcaagctgtcgcactcttcccggaaggctgtcggggacctgtaaataccggtcattgaattgattctgctcacggtatcgtttcactttcacttttctgagatcattcagcttaaagacgggcgcctgaaaagtcaccgtgtaccgtcccatattgcggatgttgcccacttgttcactgaccggcgtaatttgctcggtgtttccgttcatttcaagctgaatcgagtgcttcggtttaatattggagacgccgatcggatacatgacgtgattatagagataattctcatcaatggacacctgtgccgtataccgtctcgtctgcacactccggtcaaaccatatatcttccacattgccgccgttcagtttataggacatgccctgatcggtctccacccagcctttccccgtgtatgtatctttcgtttccacccggaagtacgcccgttcttttcccttccatgtaaaaaccggcgtatcatcctcctgaaaaggaccgcccaatgtttcatcatgattgccgtagccgattttactttcggcggcgggcacttctttgtggtttgtgattttttttagaaacggcacgggatccggccagttcgggtctgatttcggagccgccagaccgaacactacggaagcgcagataaacagcatcagcggcagaaaccatttgagtatcaatctttttttaaacgctatgtgttccgtaagccggatgcgctccatatacaaaagccccatcatcaaaaagccgataaagacgatccggatgacggcgtacgcggcatcataaggagtaaacgtatcaagcacggtgatatacgccaccgtcatgataaaaaagaataatattttccgctgatagatcacccagtaatgcagcaaatacacgagcagccataaaagcacaaaaaacagcaacgtgcggaatgacggattcatatcattccatcttccggttccgatgtggcgggcattttgcatcacgtcccgcaaaaaagaaacgagccattccggctgaaaaatagaacctttataaaacaggatgtgaatactgatcaacgtaaacagaatgcaggacggcacggtcacgtaccacctcatccggaagaatgacagcagaaatgccaaaccgataaaaacgatgaaaaaaccggtatgttttgtatccgtaaaattgtgcagcggcctgagccattcccataacaataaaaaagcgagaaaataaaacagcagcagactcagcctgcttccctggttctcgtcatgcggcatggcgcgccacctctctttctaaacaacatgggacacccgtttgtccctgatcatttgcaccttaatatttttctgagcgaagatgagagcgagtttccgttctttctccgaaagcgcggcattcgtttctttcgccaaaaacaccgtcatgtcagcacggccgggctcagcctgtttgagaaggtcttctgtaagactgcccgtcacgacggcaatggaagctttacccagttctttccctaaacgcccgcctgcatcggcttcttccgactctgaagctgatgccaggtaacgcagcatctgtctgaaatgccgctctccctcccggacgggaaatacagtccggtcgctccccaatgaaataaatcctgcgggagagcccttcacaagcgccgtgtaaagcagggatgccgaagctgacaccgcggcttcaaacgaaggggacggcctgcagtccaaaaggagaatcatattcatactctgcaacgggtcaaattccttcgtcatcagctcatttcgacgcgccgatgttttccagtcaagtgcggaaaaccggtcgcccggctgataatttctgacgctcgcagccattgctgtgcggtgtacctgaaacggagcgccggcacccgcaccctcttctccggatgcagcctgcggcttatagtgaacaggcccgtacgccgggaaaaccagaaccgtatccgttacggaaaacgacgccgtcttgtccaaaagcccgagaacatctcccgtccgaactctgatcgtatgtaaatgatgctctccgcgcggcacctgcggcagctcatattgtaacgtcatcttcctttgaaaccacggaaacacaagctgtttcgcactgcgcctctcaccaagcgtttccggcatcacatcttcaatgaccatatatgtcagcggaaacggcaggcgcctcgtcagcctgatggtggcagacagcctgtcgcctgaggttaactgggcggaggacacgtcacgcgtcacctgaaacgcccgcaacgggtacacagcgaccagcccggcgtaaacggtaaacggcaaaaacgcataaaataaaaaccagctcacaaatccgccctgaaacatggcataagaaaagacagccgccgtcagtacggccaacataagcagcttccagccatatagaagccaatgcatcttctttctcattagcggaccgacatcctttgaacgggaactttttccgtttgcatgatgtcttctataaccgcttccggcgtcacatcgttaaatttcgcctcggcggtcaagatcattctgtgcggcagcgtatacggagccaaatactggacgtcatcaggaatgacgtaatcgcggtcatgaagcagcgcgtacgcctgcgcggctttcattattgaaattgaaccgcgcgggctgacgcccagatgtacggacggatgccggcgggtatgctgagtaatgccgacgatatacgctttaactccatcatccacccgcacctgctccagtttttgctggagggtgatgaactgttctttagaaatgacgggctcgattgtttcaagcggattgcgcccttcctgcaaagacagaacccgaagctcctcctcggcagtcgggtagcccatgcgcagcttaaataaaaaccggtcaagctgggcttcgggaagcggatacgttccttcatattcaaccgggttttgtgtggccatgacgaaaaacggctcagccagccgcattgtctttccgtcaatcgtgacattcccttcctccatcgcctcaagcagggaagactgagttttcggagaggttctgttaatttcatcagccagcacgatattccccatgatcggtcccgggcggtattcaaattccattgttttcgtattataaatagagacacccgtcacatctgacggcagaagatccggcgtgaactgaatcctcttaaagtcagctccgatcagcttggccaaagcccggaccatcatcgtttttccgactcccggcacgtcttccagcagcacatgcccttttgcgagaatggcggccagactgagtatggcgatatcccgttttcctatgatgatgttttcaatatgctcaacggctttctccagcagcggatgcagctcttctttataagccattcttctcctcctagtcatctctcaaatttcaattatcgtaacctaactttaccacaaaatataaacagtataaaaaaacgtttccagcgaattgtttccagtccgaaaaaggaaaaaagctccctttagaaaggaagctttatttcagctggagaggctccatatgaacgtgtgaatggtcaatggcatgttcctctttcatcccggcgccttctgctgtacgaatgcgaaaaaaatgtcatattttcttacatcattttcaactgtctgtggcatttatgatagaataatacttgtctgaatattcagcataaacaaaccaaaaggaggcaaagaatgaatcagcctaactctttatctaagggattaaaaacccggcatatgaccatgatttcaattgccggcgtgatcggcgccggattatttgtcggaagcggatcagtcattcattccaccggacccggagcgattgtctcctacgctttagcaggattattagtgatttttattatgagaatgctgggggaaatgtcctccgtcaacccgacaagcggttcgttttcacagtacgcgcatgacgccatcggtccttgggccggttttacgatcggatggctgtattggtttttctgggtcatcgtcattgccattgaagccattgcaggcgccggaatcatacagtactggttcccgggcattccgttatggctgacgagtctgcttctgaccgtgctgttaacactgacgaatatttattcagttaaatcgttcggcgaatttgaatactggctttccttagtgaaggtagcgacgatcgttgtcttcttaatcgcgggatttgcgttcattttcggaatcgttcccggcagcaagccggtcgggctggaaaatttggcgggcagcggcggatttttccctaaaggtccaagttccgttctgctcggcatcgtcgttgtcattttttctttcatgggatctgaaatcgtcgcaatcgcagcgggagaaacgtcaaatccggtcgaatccgtcacaaaggcgacccgctcagtcgtttggcggatcattattttttacgtcggctccattgcggttgtggtcacactgctgccatgggattcagccaatattttggaaagccccttcgttgccgttttgagccatatcggggttcccgcagccgctcaaatcatgaatttcatcgtcctgacagccgttctgtcctgcctgaactccgggctttatacgacgtcacggatgctgtattcactggcagagcgaaatgaagcgccgcggcgttttatgaaactgagtaaaagaggcgtaccggttcaagccattatcgccggcacctttttttcctacattgccgttgttatgaactacttttctccagactccgtatttttgttcctggtcaattcatcaggggcgatcgcactgctcgtctatctcgtcatcgccgtctcacatctgagaatgagaaagaaaatcgaacggacaaaccctgaatctcttaaaatcaaaatgtggttctatccgtacttaacctacctgacgatcatcgccatttgcgccatcttgttatctatgctgtttatcagttcaatgcggtctgaatttctgctgacaggatttattactctgctggtacttgcctcatatgtattccgcaaaaaacaaaaaccgaaagagagcgcttccgaaagccgggttgcgcaataaccgcaaacaccccccctcaaaaaagggcgggtgtttttttaaccaacctgttccaggcagcattaactgtagtacaggatttcaataaatgataaggacaggatgaaaaatggcactagaaaaatttgcagatgaactgccgattatcgaaacactccagccgcagaagaaatcagacggcagcacgtattacgaagtcaccatgaaggaatgctttcacaagctgcaccgcgatctcccgccgacccggctttgggggtataacggtttgtttcccggcccgacgatcgacgtgaacaaagatgaaaacgtctatattaaatggatgaatgacctgccggataagcattttctgcccgtggatcataccattcaccattcagaaagcggccatcaggaacccgatgtcaaaaccgtcgtccatttacacggaggagcaacgccgccggacagcgacggctacccagaagcctggttcacaaaggattttaaggaaacgggtccttattttgagaaagaggtataccattatccaaacaaacagcgcggggctctgttatggtatcacgatcacgccatggcgattacgaggctcaatgtgtacgccgggcttgccgggatgtatatcatccgcgagcgaaaagaaaagcagctgaagcttccctccggagagtacgacgtaccgcttatgattttggaccgcacgttaaatgacgacggttccttgtcttatccaagcggacctgctaatccttccgaaacgctgcccgacccttccatcgtcccgtttttttgcggaaataccattctcgtcaatggtaaagcgtggccgtatatggaagttgaaccgcggacatatcgtttccgcatccttaatgcctccaatacgagaacattttctctctcgctcaataacggcgggaagtttatccaaatcggttctgacggcggactgcttccccgctctgtcaaaacacaatctatcagcttagccccggccgagcggtatgatgtgctcatcgatttctccgcctttgacggagaacatatcattttaacgaacggcaccggctgcgggggcgacgtcgatccggatacagacgccaatgtgatgcaattccgcgtcacaaaaccgctgaagggagaagacacaagccggaagcctaaatatctttcaacaatgcctaatgtaacatcaaaaagaatacacaacatcaggacactgaaactcacaaatacgcaagacaaatacggccggcccgttttgacgctgaataacaagcgatggcatgatcctgtgacagaagcgccgaagctcggcgcaacggaaatctggtcgattatcaatccgatggggggaacccatccgatacacctgcaccttgtttccttccaaatccttgaccggcgtccctttgacttagagcgttataacaaattcggcgacattgtgtatacaggccccgccgtcccgcctcctccaagtgaaaaaggctggaaagacaccgtgcaggcgcactcgggggaagtcatcagaatcgcggcgactttcgctccttacagcggacgctacgtatggcactgtcatattttagagcacgaagattacgacatgatgagaccgatggacgtcacggataagcagtaaacaaacatccccccctttctccagaaggggctttttttatttatccaaaaagaaaaaataagaaggcgcttttttgcatatactgtaataacaggaagacgatgcaccctcattggaaatctggatagaaaaaggaattaggagattagggaaaagtatgagacaatgaaggagtgcacgaaaattcataagggaagaagtgactttatgtcttactacaacaaacgtaatcaggaaccgctgcctaaagaagatgtcagtacgtgggaatgcacaaaagaggactgtatcggctggagcagaaagaattttgccggcagtgataccccgacttgccccctttgcggcagtaaaatgatcgacggcgtccgttcgttggtaaatctccaaaacaataatcaaacggcatcaagttagacctcccttttacgagtctcaacatagagaaggcctccatgtctcatgagaggcctttgcgttatcatgtccttttatgatgcaaaggagcaatgaacatgaaaaacgatcggcagcagaaagatctgaaggaaatggcaaaacggcggaaaatgaaccttgccgcacagtcattcatcgaaacgcttcattttgccgttccgattctccgttttttcaaatggctcgcctcagccgcagccagctttgttcatgaaaaaacacccagcgggcgctgagtgtttttttcatgattggatgacggaaaaactattgataatgccgtggtcattttcccagactttttcgcattttttcgtatccaaatgataagcataaatggtccggaccttcgcattccgccccgtttcatccttcagacgcttagcgccttttgcttccgccatgaaataaatgatgctgccgtctttagaaaactgaggctgggcatcaatcagcggagcgaagtccttcccgtttgagataatcgttttatcttttttcgttttgacattcatcagacggatggacgctttttgttccgtccctttttgtgtataagatgtaaagacaaggttctttccgtccggtgacaccgccacgccgctgataaactgttcaaggtttgtcaggtcctgaaggtgttcgccagctcctgctgcaaaccggatattcgtcggttcagggtcaatccccttctcatttgcctcatccgttttttgataatcctctttgacggaataatgcagaagcgcaaaatcgttttggctgcggttataaaagaagctgcttacactgtcgtctttctcatcggcggcaggatacagattttcataacgtttcgttttcaaatcaaaagatgcgagacggaaaatatcttcatccgcttttccgagacggaaataaatgtgcgtcagatcctttgataaaaacagactgtcagcgcttgccgttcctttataaagcaccgtcttctttttcgtcttcagatcaagcttatacagacgcatctcattttcgtcattattcccgacaaaatagagcacctgatgggcgtcatccagcgcaaacgccggatatgccgaaagcttttcctcgtacagcacgcggccgtcctcgtaatatttcgtcatcagatctttgtctgtaatggaaacaagcagcttgtcatggccgccggagacaacggcttttccgccgccgtcgctttttcctttgatcagtaaaacggacgcgatgaccgccgccgccaaaacggcggcaagcaacatccagatccatcgtttcttcttcattatcaatctctccgtcaatcagaaaaagcaagaatcagagtccttgctttttaagatggtctattttaatagctgtagtgtccggatactcttcctttgcttaacggatatccgagcgctttgaacgctttcgggctgacatccaatacggcattcggcagacggcctacatcatttttatatactgtgataaccttttttggttttgctttcgcataagctctgattttcgttccgtttctcggaacgtcaaatcctaattttgtcgcgcaatcccagtgtcccagttttttaccggaagatccttttttaccgactccattataccatgtaatatttccgttcacttttttagcacttgcatcagaagagaaactgatcgctcccagcgtgcttcctgctaaaatcaataaggctaagaataacttcttcaagctttcgtcctcctgattctttattctaggcaaaattatacaccaagaagacgattataatatttcaatcactttacatgttcattacaacgtgatgagacatgcacataacgacggcacaattacctgttctatataattccatggtaaattatactacaaaatttaattcattagcgttataatattcatagagtatttctgcattcaatatggactttttataaggcctattgatagttgcataatatgatatattttgagaaatcaggctttaggaagcactttattccttttaaccgtggttcatattgatcatgtacctatactcgtttcaatcagactaggagtgataatcaatgaaagcggcaagatggcacaatcaaaaagacattcgaatcgaaaacattgatgaacctaaagcagaaccgggtaaagtcaaaattaaagtcaaatggtgcgggatttgcggaagcgaccttcatgaatatttgggaggcccgatctttattccggtcggcgaacctcatccgttaacaaacgaaatggcgcccgtcacgatgggtcacgaattctcaggagaagtcgtggaagtgggcgaaggcgtcaaaaattacagcgtcggcgaccgtgtcgtcgtggaaccgatttttgccacacacggacatcagggagcctataaccttgatgaacaaatgggattcttaggcttagccggaggcggcggcggattttctgaatatgtatccgttgacgaagaattgctgtttaagcttcctgaagagctttcttacgaacagggcgcgcttgttgagccgtcagcggtagcgctttacgccgtccgccaaagcaaattaaaagcgggcgacaaggcggcagtttttggctgcggaccgatcgggctgcttgtgattgaagccctgaaagcggccggcgccacagatatttacgcggttgaactttcaccggaacgtcaggaaaaagcgaaagaactcggcgctatcatcattgatccgtcaaaaacggacgatgtcgttgaagaaatcgctaaacgcacaaacggcggcgttgatgtttcttatgaagtaacgggcgttcctgtcgttctccgccaggcgatccagtcaacaaacattgccggtgaaacggttatcgtcagcatctgggaaaaaggagcggaaattcatccgaacgatatcgtcatcaaagaacggaccgtaaaagggattatcggataccgtgacatcttcccttccgttcttgcactgatgaaagagggctacttctcagcagataagctcgtcacgaaaaaaatcgtgctcgacgatctgattgaagaaggcttcggcgctttaatcaaagagaaaaaccaagtgaaaatcttagtcaaaccgaactaaaccgttcagctgaatatcagacacatccgaaaaagagccgttccggctctttttttcatctcatcgtctttccttccttttccttttaaaaatgatcccctctgcgcaaactatttttcaccctgtcccgtctatccttaggcagcagcctatgatacgtattttttaaaaaggagccctttgaagcaatgaagaacgaaacagccaaagcgtcgcttgtgacgtgcataactgagcgcaaggaagacttttaccggcttgcgtacagttacgtaaaaaacaaggatgacgcgttagatattgttcaggaatcaattcaaaaagcgctgacatcggtcgaatccgtcaaaaaccccgatgtgatcaaaagctggttttataaaattttagtgcgcacggccattgattttctccgcaaacagaaaaaactgaaagtgatggatgatgaaacgatcgagtttttaagccgaggaaaggaagatcactacaaggacacagaccttcacgaagcgcttgatgacctgccgcatcaatataaaaccattatcattctgcgtttctttgaagacctgaaattagaagaaatcgcggacatcacgggggaaaacatcaacaccgtcaaaacacgcctttacagggggctgaagctcatgcgcattcagctgacgaaggaggatctttcttaatggaaaagagattagaacaattaagagaagagtataaaagtgtgcccattcctaaggaactggacagcattgtcgaaaaagcccttcagcaaaaaccgaagaaaaaacgaatcgtgatgtggccgacatccgcggcagtcgctgcggccgtcttatttaccgccgttgtcaatatcaacccggatgccgcacaagccatgtctaaaatccccgtcatcggcaaagtcgtccaagccatcacattcacggagatgaaggaagaaaagaaccaatcaagcattgatgtgaaaacgcccgctctgtccggactttccgatcataaactcgaagacagcatcaaccggcattatatgaaagaaagcaaagagctgtatcaggaatttatgaaggcgacctcaaaaagcaaaaaaggccacctcagtatttacagcgattatgaaaccgttactgacacagcggatctgatctcaatccgccgtgatatcgaaaaaacgcaagcttcatcttatacgcaaagccgttacatcacgattgataaaaagaatgaggccgtgcttacgttaaagagtttatttaaagatgaccgttatattaaagtcatcagcgaaaatattaaagaacaaatgaaaaaacagatgaaagaagatccgaataaaatatactgggtcgaagaagatgatatgacggagccttttaaagccatccgcgccgaccagaatttttatattacagataagcacaaacttgttatttcatttgatgaatacgaagcggcacccggatatatgggcgttacagagtttacaataccgacctccgtcatctccaagctgcttgtcggagaccgctacatcagataaagaaagaaaaaaatccatgatatccgcagatcatggattttttctttcgtcccgcaacagccaagatgcataagggacccttttcatataacagacgccggactgggactgaaaagtttaagaaaatcacagcatttcatacattttttctgaaacaaaatccccttccgaatgcgtctaattaacggaacaaatggaagactgtacagaaatcagctatagctatccgcaaaacagcgagaatttccgcacacattattggaggaataccatgtcagacaagtcactgcatcaccgctatattcccggactggatggacttcgcgcctttgccgtcctcgcagttatcgcatatcatctgaattttaactgggccgacggcggtttcattggtgttgatatcttttttgttttatcggggtatttaattacatctattatattgcctgtccaaggcaatgccatcacccttgatttgcgtgatttttgggtgcgccggatcagacggcttctgccggcggcttatctgatgattatcatgacggtcatttgggtcgtattgtttaacagcgagctcctgcataccgtacgcggagatgcggtctcctcacttttttacataagcaattggtggtttatctttcatcaactttcttatttcgacagcttcggctccccttcgccattaaaaaacctttggtcgctggcgattgaagaacagttttatatcatatggcccttcctgctgcttgcgggaatgtacatatgtaaaacacgggcccggcttgcggccgcggtcatgttcctcgcgttatgttcggcagtcgtaatgagtatgatgtatgtgcccggcggagatccgagccgcgtttattacgggacggatacccggtcatttgaattgctgatcggctgcgctttagctttagtgtggccgatgaaacgattatcttccaaacggctgccgagcagcatgaaacacctgcttcacgggacggagcttgccgcttttgccgcgctgctgctttgcgtcttttacacggatgaatatgaacccttcctgtacaagggcggcatgcttttgatcagcatcaccgcagcggttcttgtcgcatgtttatgccatccgagcagctttttgggacatgtcctttcatggaagccgcttcgctggatcggaacgagatcatacggaatctacctttggcattacccggttttcgtactgagcacacccgtgcaggaaatcggaaatccggtttattggcactgcgccgtcagaatcggcgccactttcattcttgccgagctatcttaccatttcattgaacagccgatccgcactgcgggcttccggccatttttacgccgcgtgtttctgaaccgctttctggaatggaagacgtcctctgtcatcagcagaatgtcgctcggcctcattcttgccgccattctcgtatttgcgggcgggctgtcagggatagccgaagagaaaaaacagccgcaatggacgtacgcgcagaatgatcagcaagaaaccgccgcctcttcgcacaaaacggccgatcacgatcagcctgcaaaagaagaagacagcaagaaaaaacacggcggcgaaaaaacggataccgcgtcagacaaaaacaagaaagaaccagcagacaaatcagatacgaagaaaaacgacgagaaaaaggaacggtcatctcaaaaaacggctgatccaaaacaaacacagcctcagcaagacgtgctggccatcggtgactcggtgatgctggacattgcgtcatacctgcggcagtccctccctcatgtcaccatcgacggaaaggtaggaagacaagtctctcaagcactccagctcacttcggaatatgcgtcatttaatcagccgaacaaagcggtcatcatcgagttagggacgaatggctatttcacaaacagccaaattgaatcactgatcagctccttttcaaaagccgatatctatcttgtcaacacgcgtgtaccgcggcagtgggaaagcaaagtaaacgaatcattgcgccggcaggccgagtcacgcaaaaatgtgacgcttgtcgattggcacgcaaaagcattgcagcaccctgaatacttcacaccggacggcgtccatctcatacctgagggatcaaaagcgctgacatccctcatcgttcaaacaatgaaatcatgacaaaaaaagaggccccaaaaaggcctctttttcgtatatcatcaggcaagtttctgtccgcaattcgggcaaaaattcgcgccttccgttttcgttccgcagttcggacagaatttcggcttagccgctccttccgagccgtttgcctgttcggtcccctgattctgctgactttgattttgctgcggctggttctgctgattttgattcatttggttcatcatttgatttgccacattcattcccatcatcatgcccgccatgtctgaggcggcgccgcttccgctcattttgccggatgacatgccgtccgtcatggaaatctgctgatagcggttcacatcgcccaccatgccgtaagaagcgtttttcgtaatcatatcctgaacttcctgcggatagttaaagctcataatattgaagcccgtaatcgacatgccgtctccgatcagctgcatatcaagatcttcttgaatcccttttccgatttcaaatgaattcgactgcagattgaacatgtcttttccttctctggtgatccatttcatcaaaagctgatcgagaatagacgtaatccggattttaatgtcctctactaaatagctgtctctgacacccgcaatcttatcaatcaatccgatgtagtcaatgaccttgaagttaaatgtgccgtttgcgcggatcggcataccgcccggcatacctgccgccggaatgttgatggcgttttttgtgccccacttcacggtgaactccttcgtattcacaaacagcacttccgcccgcatgccgctgttaaagccaaacttaaacccttttagtgtcgatagaaacggaatgatttctgattcgatatcataatcgccgtcatcacggaaaatcccttcaatcttcccgttgtataaaaagatggcatcctgtcccggccggatgatcagacggctgccttttttaatttcacggttgttccatttatagaaaaccatgtcgtctctgaattcttcccattccaccacatttgctaactgatttctgaaaaaacccatgtatgctcaaatcctttacatataatttaaaaacttcccttgcttccgctgtaactcgtgccgcccctcgtgactccgccgtcattgtcattatctttatctggctttttttctcttgtaatgtcggttcggatatatgtgtcgtgctggctcagcacttcagacgtatcgtgatccatatacgtgctgccggtgacggtgaccttgccgccggaattgtacaccatcacggtgacggcgattccggccgctgctgcagcgataatcagctgaaaccaccatgtgagcagcagattgtcagacctgtcgtccgggcttttccccatatctttataagccatcttgatgtaagtctgaaacgccttttcataatggcctgcggaaatatctgacgagatcgtatttctgatcgtattcagccggctgctgttcaaatacgtctccgcctttttatatccggagagaaatacttcccgatccttcatatcaatagtcaatatcgccgtgcttccgctaaaatgactgtcataaaaatcaccggcatactgttcgatctccttaccgcccgttccgtttgcggtaagaatgataaaatcggtatggcgcttttctcccagcttcccggccaattcctcaagtttcttcgtttcatccttcgttaataaatgagcattgtcataaacatattgcttctgttccgcggcagacgccgatgtatgtaaagaaaaagacagcatcagaaaaaggacgaagcagaagagacacgctttttttatcgatactttcatcaaaaaccgcctcctatcataagtgagacgagtcttaatgctaaaaacgcaccggcggttatgccgccgaaccacgcggccacttttccggcactgatcggcggtttgccgacaaccttgcccgtctgcccgttcatcgcaaaaatgtgctcagcccgctcatagtcgtagctgaccatccagaccggaagcagtacgtaaaagctgctgattttatcggtctgaatctgctcatccgtaatgtcagccgtcgtatacccggagaaggtggatctgatataagaatcaatataatggctgattttatccttcgcccgcggaaagagatcgtcatcggtataattgtacttttccgctatatatcccgctaaataggccgtattaaactccttcagctcactgtatgagtaaggctccaatttgtccattaattcatcattcattttttctgaagcgtcgaccggaattttgagataatcaagattgatatcgcggtacgcgttgtaatactcggtctccgtcacccggtattctccatcttcatagtgatgcactctcgtacaaacggcattgacctgaaccttgctgtttaagtcaaacatccaaaacggcacgtacatgccggttatgctcttcacccgatcggcagtcataaatcctttcggtgtcagacggccgtttcggcaccactttttaaaagcgctcatggcttcttctttactgatcgtaaaaggaatcaccatcgaaggcgcgagatttcccgataatcggtcggcgagaacggcggctcctccgcaaaacccgcacgtcgtggccgtcgtttccgcctcagtcattaataccgcgccgcagttctcacagcggtactcgttcgcctcattttcggaaaatctcgttgttatatactcttttggcaggctttcaatctgatcctgccgcccgcagctgtgacatgtcagcatgccggatgaactgtcaaagaccatatcatcgccgcagttcgggcatttataagaaatgatcattctgtttctctcactttctctttatatcggacaaagctgcagcccgctgtctattgatctttactgaaaagcattttctgcttaagcgccgccaactcatcgtcgacactgctttgattgctgtcatatttagccgtcagctcgtcaatatcgtctttcggagacgcgttgagctcagccatcgcattggcgtgatcaagcgcccggttgaccttgtcttccattctgccgaaagctgtcagcgattggcccgcatttgacacagaggaccccaatttgttcattctctcctgcgtttttgccacagaccacttcgctttgatggcatttcttcgcgactcaagctctccgatatcagcgacaagcttgtcatgcattttgcgcatttgagacgcgttggaagaagcgagctgataagccgtttgcagctcagtcagtcttgattcaacagccgttttcctttccaaaaatgtccgcgcatcggcttcattgccggcctgcaacgctttcatcgcgtaactttccatcttttcggcatcagcctggcattctgttaatgctcttttcgcccgctgttcctcagccatgacagaagccgtctccgctttcacttttcctaaatcactgttcagattccgtaaatattgatcaaccattttttcagggttttcagctttatccagcagcgcattgatattgcttgacataatgtctttaaatcttcctaaaatactcatttttcattttcctcccaaaattaaatagtaacaagttcacagttatatatactgtttttttcgaaaaaggtttcattttctcttgaatttatgtatttttatatgaaaatagtctcattcagcccatttgtgccggcggaaattcttcacgagcagatacagtgagaacaaagaataaacaaacagcccgatcatcaacccgctcactaacggataatgcttcgccgcatacacaaagaaatccagctgcgaaatctgttccggacttgtaatcgtatccgtcccattcaaaagctttgagaatttagccgtatcattccaatcaaacgagtcagaaacaagctcactcccctgataccaattgacagcggcgagacaaagaaaacaaaaaacagaaaacgcgcattgcacaataagaaaaacatgtttcataaaaaaattcctccgcggttcaatatcacaggccgtcacactgtacatgacggcagcagcagaaacttggttttactcagaactgataaaaacattattgtatgtacttcacagcggttcaatttactggatgcctttctaaagtataccgtatatcgaaaagggtttcagacctaaataaagaggatgcttcccgaagtccgatgactttcaagaaacatcctccatactttacagtgatacttcaacctcttttaagctcggcaaagcatcaatcgcaccgattttggtgcacacgagcgcccccgctttattggcaaatgagacaatatcacgcagcttcgcaaaatcttcggctgccgtctgaacctcatccgtgcgcgccagctgatacagcgccgcgccgacaaacgcatcgcccgctcccgttgagtctattgatgtcaccggaatgctcggaatgatgtcaatatccttcccatttgaaagaagggtcccgcttttccctagtgtcaccgccacaataccggccccaagctcatgaagaaccgcaacgccttctttatgatccttcgcaccgctgatgatctcaagctcttcgtcactgactttcacaaaatcacttacggcaatggctttttttgcggtgtttataaactctgaaactcttcctttccataaatcctcacggtagttaggatcgaaggaaataaactgtccattgtctttcgcaatcgacatcagccgtaaataggccgagcaaaacggatcagataacaatgccgtcgctgatccgaaatgaaggattttcgcatcgtttaccttttccagatcaatatcatcaagcgtaaacaaagcgtccgctcctctgttaaacacaaagtcgcgctccccgttttgttttaatgaaacaaacgcaagcgttgtaggcgctttctcatccatgacgagcatagacgtatcgacatgtacggcgtccaatgtctgcttcagaaagtacccgaacggatctttgcctgttttcccgctgaaagccgcgtctccgcccagcttagcaatggctgccgacacattcgccggtgcgccgccggcactttttaagaaattgcgcccttccgtcaaatcaacatccacatcggtacaaaagaaatcaattaacaattctccaatacaaataacagattgccttcccacattatcacactcatttatcaattctcgattatagtttcagtatagtgctttctgtcataaatacaaccgtttacatagaatattttaaattttacgtatacttatctggcagccctttgctccagatcagacatcatctgctgatattttttttcagttaaaggataaaaagaaataagaataatagacagcagaatgaacaatcccggaatgagcgcattcatatttttaatcgcattcaatgacgaggcggtctgatcggtattcgcggcatatccggcgattccgagataaacggccgaaaatgaccccgctaacgcaactccgagcttattgatgaaactcatgctcgaaatcaccacgccatcagcccggactccggttttccattccgcataatcgacacaatcggcaaccattccccaagcaagcgtatttaaaggcgtcgtgaaaaatcccgaaacgaaaagccaaaagaaaataaggggaatcgaggaatacgatgtaaactgaaggcccgcataagaaatcagcgataacgccgccgtgatgatcatgacctgcttccggccccgcttcttagaaaagaaaggaataaacagattgctgatcagcgctgcgccgaaaaacagcacggttcctaaaaacacaaattccttatggctgacgttatacgtaaaatagtacaccatcgtgctgagcttaatgttaaacccgatcgcaaaagctaaaaatgaagaaaccaaaatgagcaaaggcttgtttcggaacaaaacagacaacgtctttttcattccttgtttttttcttttttcaggctgaatccgttcccgcacggtaaagaagctgaacagattcaatgcgatgctcaccgccgcatagataagcgccgtcatctggaatccgaacgcctgatctttcccgccgatggcgtccgcaagcggtgtcgcacaggaaatcgataacagaattccgatataaaccaaaatcatccgggtcgtcgtcagaaccgtccgttcctccacagaattcgtcatccgacccgttaagctgttgaccggaatcgtctgcatgctgaaggacatcccaagcagaatataagtgatgtacgcataaaccatgttccctgtctcgccgaaatgaggagtcgtaaagcataagaacgtaaataacgcaaaaggaaacgccacccacaaaagatacggccttgcctttccccatcttgtattcgtcttgtctagaatcacgcccataatcgggtcaaaaatagcgtccagcacccttacgataagaaacaaagctgcgatgaccgcaggcttaatgccgccgacatctgtatagtagaataataagtatgcgtttacaaactgaaagataatattgtacgacatatcgccgaatccgtagccgatccgttccatccaggacaggccgcgatgtttcgtctttactgccgatgctttttctgtttcaatcatcatttcccaccccaagaatccgttttcatttttgataagcaagagggagaatgcaaagatcctccccgttcactcagcgatttggatacaccatcacttttaggcattcatttttgtattgaaaggcgcgttccatcgcctcttgcgtcttctccagcggatattggtccgttacaagatgcttcgtgtccactatgccggaagcgagaaattcaattcccttcggatacgtattcgcataacggaagattccgtatatatcaatctcgttatctgcaataaacggcacattgagcggaatctcgttctgagaaggcaaaccgacaatcgccagttttccgccccggcgcacggaagccagtgcggattgcaatgctgccggattccccgctgtttcccaggcagcatcaacgcctctgccattcgtgatcgttttgatttcttcaccggcatcctgttcccggacattgatgacatgcgtcgcgcccatttttttcgcggcatctaaccgcagcggctccaagtcggtcacaatgattgtgcctgccccgtatgctttcgctgccgcaacggccatcagccccacaggacccatgcccatgatcgcaaccgtggaaccgggctgaagcttcgttctcgcggccgcatgaatgccgacagaaaacggttcgatcaaagccgcatcttcataggaaagtgaatccggaatcgaaaaaacaaagtcctggcgcattttgatatattggacaaacgcgccgtcaaccggcggtgtcgccaaaaactgtacatccgggcaaagattataacgcccttctttgcacgcttcacagcgcccgcatgtgacaccgggttcgacggcgacccggtctcctattttaaattgatcgacagacgatccgacggcggcaatttctcccgcgcattcatgaccgaggataaatggtttttccactacataattgccgattctgccatttgtatagtaatgcagatcagatccgcaaattccgacagccatcaccttaatcaacacttcatcatgattgatgtcaggcacgggcaatgtttcgattttgatttctctcgtgctgtgcataaccgccgctttcatgttttgaggcactgtgtgagtcatttggcaaaatcctttctctgctttgaaatgtaagtgcatacatttttgttttctctgttactgcccctattttatctgcttttccatacgttcaacagcctttcctgctgtataaaaggacagccgcactgtactttttattttttcatatacaaaaaacactgaattgataaaatagtactaataggaggtgcaggctaatggctgaactagaaaaccggacacaatttgcagaactgctggcacctgccgtcaaatcgctgaaacttcatcctgattataaagtcagaaggaaaaagaacgaaaaaacaggacagtcttatatcgatcaaatcgcactccgattaggcgtttcctctaacacgatcaaaagctggatcggacagatgggcgcaaactacattcccggacgaattgacgacggaaagctgttcggcatgatctggatcattatcgaaaagactgacatggatactgaatggctgaccggccttctggaaaccaccaccattcccgtcatcaaacccgcattgcccgtttggacggcgtcttgtctaaaaaaagcaaaaatacaccggaaagacggatcattcggagcgccgagtgatgaagatgttgaaaaagcagtaaagcggctgtttcatgacagacccggccatgaaacgaatgcgcttacagaacagcccgtcacgcataacttaccgtcacgccggaccgggaactttatcggacgcggctttgatatagaggcgatccggcaatggatgctgtctccgtcaccggtctgtttaatcacaggctgggccggcatgggaaaaaccacaatcgctcttgaagcagcctacctttgtgccggcggttcaccagattggcctgcattcaacagcatcatttggatcagcgctgactggaaaggattgagcttcagcgattttttaaacacgatcgcctatcagctcggacgcgcagaacaaatagacaaatccatcaacgaaaaacggttcgtcgtccgtaatgcattagccgctcattcaaacgaaaaacccgtgctgctgatcgttgacagcatcgatacagcggaacgtgacattcacgaatttatcatcggtcttccggaaggcgtaaaagttctccttacggcacgggaaaacgtaaaacagacataccgggacggcctcggggaactggcggccatccagctgagcggccttgaacaaacggatgcccttgaatttttccatcaagaagtgcaccgctgtctgcaaacatgcaacctcccgcaaaaacgggaaaagctggagcagctgcggcggctatcgcctgaccttaagaatgaattcgtctcggcagccgccggcaacccgaaggccatggcactgagcattgcatacatgtcagacgacgacatccccgctccccagctcattcaagaacttaaacaagcgggctactcattattggaattgtttgaggttctctttggccgcacatgggacagatgtcatgaagacacacggaaactatggcagacgctttgctttttcgctaagccccctgatgaaaaaagcttggctcaagcggccggattagacgtccggcggtttcattacgcgattgagcaaatgcggtcatatgctttaatacagccggaacgaagcgaaggaagaattcaatacgcagcccatcaaaccgttgtcgcttacggagaacagcacttatccgaaaatcacgaatttgaaaaaggagcccgcagccgctgggcgcattattatatcgattatgcggaaacccatataaagcgggaacagcccaattctgtctattggagctatctgctgggacggaatttagagcaaatgaaaaaggaatggccgaacatcctaaaggtcatcgaatggtcgagtgaaaccggacaacatgacatcctgatcaaactcatcatccgcatcagccattttctaagcagaatcaacctgcccctgcgaatcgaatacggattaaaagccgccgatgccgcccgtcaatcaggcgaacacacgcgggaagcctacttcaggatcgacacggcaggctgggcgctgatggaagttaatgatgcggacgaagccctcaggcaaatagaagccggcctgaagatactcgaacaatcaggcgcgccggatcacgacgacttgaaagtatggggaatcgccctgcaatcgaggctgctgttaaaaaccggagaaccggacaaagcggcagcaatgctggacggcatcaaagatcagcccgtctcccccattatccggcacagggttcttctggtccgcggcgacctgagtttcgcccgctctcactacgaagaagccatcacattatacgaagcggcaaacacaaccagcgccgcatacggcggcgaaaaaacgatagaagcctatttcaacctgggcatggcttacgtcaagtgtgatcaactcgaaaaagcggaaaaagcctttgaacaaatgctctatgacaaacacaacgccaatcaagttgagttgatctattactattacggaatggcacagctgttgtatcgtaaaggagaaaatacgaaagcgatggaatcgaatcagaaggccattcgtctgattgattcgtgggagcctgggattgggattcggggtgaggtggagcagctgagaatggtgcttgaaggaaatgaggaaatcacattgtagttaggaaagtgtgaggtcaatcttagacaaacgatctcataccttctcttttttataaacaaaaaaggtcttatctagttgagtaactgataagacctttctgatagaacgctatgagcatttcaagtgaactcaacagtcaatcccttggtatacccaagggagattacatcatgccgcccataattaccacggttttcgctcgctttcgcaccctttcaatcggtgttatttttttagtgtgatcatgaatggaaaagaaacaaaaaccgcattgtttcagaccctgacgcaactttcgttatttttgtgttattttttaaaaaataacaggtttgtttgcatcgcgaacacacgttctttataatcgtctccaaggagatgaaacacaatgaccgattttgagcgtaaagtgtatcggattatttttaatatgacccgcttcgggaaaaatccctccatggaacaattgaaaaggaaaaccgggaaagatgagcagacgatccgtgctgctgtgaagaatttgatgaggcagcgcattttgaagtgggataagcataaaaacaggtggaattttaaataaaaaagaaagcagggtatctccctgctttctttagcgaatatgtagcgaatagtaataatagcgtatgtgttttctaatgtgtattcataatacatccaatatatatttcctgtcaagcaaaaaagcaattattttacaacttgtgcttgatcttctgattcagttattttagctaaccctaattcagaacataagatttgatttttggaactgccctttaatttacctttgcttaacacttttgtctcttcaacaataaagctcttttgtttaagttcctctaaaatctcactaataatctctgctggggtcgataatgtatttattagatatcttttgaaccaactcaagcctaagaacagatctccttgtgtaccaaagctatcgtgccatttctttatctcaacaagaatttgattcataagtttatctcggtcatactgcttttcttcaataccaagtaaactcgccaaatcttcagcatgatgagcataattcttaaattcaatatgtttaggagcgtttttagctgaataataaagctcaactctttttcccttgtacattaatctactcataataggaatcatgtcactatcagctgttacaaaaacataacaactaatcgaaggatccttgtatgtattttcaatagcatcaatacaaagttcaatatctgatgcatttttacgatgatccccatcttttccatttgaataaacatgccttatttgaacacgctttttttgaagacttgtcatattacttcttaatttgttaaaatccgcatacactctaaatgaacgtacattgtcttgaccgtatcgttcccataaccttgaaaataaatttttatcttcagattgataatctggatcatggctataattattcattagagaccagtaaacgttatcataatcaacaaaaatagctacattatcaagttttctttcagaattaaacgttcgattcgaatcgttcaccacagatgtcatgatttggaatgctgatttaagctgttcgtcaactgctggttgtggtaatggctgggcaaccgtccctgttcttttttcttttaattcgtccaattaaattccctcatttcattagaaataacacacataaaagaatttaccatatattcaccaataaaagtatattttttgacttcatactagcttaaaagttatgtatttctcccatttacaacaaaaaaagcctcgtccattggacgaggctatatcacttcaataatttttcaagtttcgcttttgttttcggcccataaatgccatcagcaggcagcccgtacatagactggaaccgtttgactgcatttgctgttttcgcgccatatgagccgtcaattccgaagttctttgcgctcttatcggggtaataatgaagagccgccagcgcggtttgaatctgttttacggcctcccctcgggtcaatgggcttgtcactttaaaaacacccgcaggcagactgaattttgatttttgagtggttttaggctttgaggcttttaccttcttttggccgccgcttttcagctcgttatcgcttttgatatatgagacattcacatatccgtggaatgtctggcctttagaattggtgtattcaacatatccccatccgttgacagttgatccaagctgatattttacaaccgtgccattcggcaggttaagcaccatggaagaagaggcgctccgttgtgtacgtaaaacaaggccatcgcttgaaaccaccgtgtttttgatgaatcttcctgtgtctgtatgggtaacatccggatttgatacaggcgccgttacaaccacaccatccattcgcttttcaacacggctcttaaaatcggcaaacccttgagagttgcttacccacggcgccgggcaaattttatgtgtaatgtcataatgtcgaacaatatcattggttggatcaagtttgtacattttgcacagctcggcacaaacttgtcctgcacgggcaatcgtatccggatggaaagtgccgttcttttcaatgcaaagctccacgccgatagataagaaatttgcattcggtttcagcgccgcgacaccccggtaaggctgcccgttgacgaattgctgaatgtcattcgcatgataggcaacctcattcaacggaatgatacaaatagcctctgtacgatcgacaaagatatgtgcagatgcaaacgtctgttttttctcagatagatttctgttctgtgcggggagcgtttggccaaaatatctataatgattggcagcaggcgcgccggggttggccgtgtaatgcaccacaagtttcttcacgccgttgtttttgattcccggccgcgtccatttattaatatcaatatattggtttctgtatgctgacataaaatctctcctattctgtttttggattcaaaaaagcagccggattaaccagccgcctgatcatctttttcttttgtctgatcgttgtcgctttcaattacgtgaagccggtcagtgatgacggccggaattttaacgccgatctgcgccaaattctccgtgatggacaggccctcatttgcgatataaaaaagaacggttccaaaggtcaggacgccgttcaaatttgttatcgtatcaataatgttggcgacgatgaccaccataaaactgagcatcttccgcacatacccaaaccacgcgctgcggctccggagctgcttcattttccacgctttgataatgccggtgatgacatccaagatgctgaggattagaagcaagtcaaggtacttcacctccccgaaaagatatgttcttgcgatctgtaagctttcaaaattcatccacacatgtattccctccattttgatcacctccttcgaggcaaaataaaaacacctattcagttacaggtgctggttcactattattttctttcgccgctactgccgcatttaattgcttttcgagttcctcgcgtttattatctgtaaacgtgtatagcgctttatattcggccagctcattgttcttcagattcaattcctgctgtagggaagcagctttatatgctgctatttgtaactggtcctgaagttgctcttttgtcatttcttgcatgcctttcactccttactcttgatcgggatacgcattaccgcgttcgctttctgtaatttcatcatattccgcttgtgtgatgcggcctttctcaacggcttttctcatttcaacggtcaaaacagttccgtttttccagcaatcctcaaaaaacccgaaaagagcacttcggttctccaatgggctccccccgtttccttttattgattcattaagagattgcaaacccgctgaaggtcaagaacttgttcctgcaacttttcctctgtagtcttttccttctctctatcttttgcttcaatatttaataccacgggctcaagcttcatctttgccatcctccttattttgaacatagattgttataagcccttctcggttgccttgtggatcaacgacaatttgaactggaatcataataagctttttgctcccactgtacccttgataataaccgtcaggctctacataagtttttgtgagcaaataacttatttcatcagcctttatatcatgaaggacatataattgatacgctacttttgttgtatcgtccggctgcagatcgaacgaaacagcctccatgggatatgtcttgtctcctttttttatagagccggcagttatttcaattcccgcgccggtttcttctatttcgatgccgtccgcataataaagactcatgttaaaatcccttttttcaaccataaaaattactcccttattgtgattcgtaaaaaataacaatttgaacctttattgtttttcccgcaactccggcagtagtcccggtccctctcactccaatatcaacagaactggcgcttatattttctaatcctaccgtaaccgcattagaatatgcgccaatcgctgtacctaccgccgcaaaaacgttctcaggcgcataatcaaaactatcaacaaaaggaatgcgattgtagcgcgcgtacgcagttgcccctccgtcaggcggcagtttaatgtcccaagtaaagcagtaaaccatcaaaccgtattgtaggcctccatgctcgtcttctaattctgtagaaacattgccacccatcaatttgaattcgcaattttttgcattccctgctacaactttggttcccaatggcagcgttaaatctgatgcatcaacaatcgttttttggcctgatttcagtcgaatgaccccggggacatcaatatctaaattattcggtttaaagcgataaatagtagctgatccttcaaaaagggcctgataacggttatatgtgaacggctctcctatatttttaggattggtagtagcagtaagaagaaaagcgtcttcttcaacagctgcctgtctttccattttcatattaaaatggcttataacttgtccaacatctcctatttctgaatacattgaaatagttggaaccgtttcatatgcggtttgcttgcctgcgccacggagctctattttgccatcaccaattgaaactgttctgtagatttcattataggaatcaccaggatcaaaaaactttccttgttcctgcgttattttcccagaactaacaatcaatttgttgtaaacataatgagagtctctggtgtactggtaaatcttatcgccttcgatatagtattcggcatcttctgattgtgtcagcgcctcgaaacgggccccttttatggtcaccccctcaatcgtgataccttttaacgtcccgacatttattttgtccgctgaaaggtctttgatcttggcgtttgttattgaaccgtcaatgatgtgtaccgaatcaattattgcttcttttagatgcgcctttgcgatagccgcattttgaatagccgctgtcccgatagccgcttcagctactttcgcacttgttatggctgcattttttatatgagctgtttctattaccgccttttggaggtggtcgccatcaataacaccatcaaccagctgagtatcaaacgggctataaccataatcagaaatgacatcgcctttgcgcacctgtaccttacgaataacaaagctacagggctcagtgtttccgtttcgattatatccgccgattccaattgtgtaatcagagccggtttccggagcagtaaatttgatattaacccttataaattggtcagacggaaaagcagaaatatctttctgttcatcgctgctaatctgtatgaaagtgctgccttttttcaaatgaatataacttatgtcggtggtattattccgttttatttcaaatgacagtgtatattgttgatctttgatcaatgccattctttgaatattaacaggcgatgacctgttcccgcatattccgaaagctattctagttgttccattgatgatctgagaaacagtcatttcattaaattctttttcctcaacactgtggctggtgtccgtataatcatagaaccatttagattttaaaagagagccaggtaagatattagcatcatcaaagtttcttgaaagtttatcagcatcaacggccagctgggccagtttttcctttgtgatcgctccgaaaacaatgtcatcagtcaaaatgcgctgagtggtcgcggaaaactgatccgtgaattcgctcgctgtgcctcgtgtgttgattgagcgcaagcgataataccaaacttcatttactcccgtaaaatgctcatatccgcctgttttgcctctgaaaatacgattctcttttaatggagtgaatccatttacttgtgaagcatatacctcataggctgcaatataactggacggatcataatcccatgtcagggccacattctgaaacattgccttgatcactacattcgacggaactggcggggctttgtcagggaaacttccatccgtaacctccccggcatccggtttgctttcccaagtaccgcggtttttttctatcacgctttcaatttgatcaatccggccgtctttttgtaatgctgataaaaattggccgatctcaacaacgcaagtattttcagggtcggtaatatcgtattccattgaaataatgcgctgcgatgtctcgattgggatagcgaagtttcgatcaattgcgatcgttgtatctcccaattccacatgttcgtgttcgtgtcccggcacgctctcaagcagctgcacagacaactcataattgatttctgtcttacatgcagtcgttatcaaatgattatatgtggcctttaaaagctcttccggctccgttatgtcttcatcattgtattggccttccctatggatcaactttccatctttaaggcgccccaatcgttctaataaatccggatcgccaacccattcctggcctaaaggcttatcgaccgggtcgccttttgattttttccattctacttcagagaaatcaataaaacgagaatagccgcccgtttcctctccttcctcatccgtagatgctatggatgccccgtaaccccaaagggctgtcaccgggtaactgataacagtccgccggatattcgttgtatccttatcactctcaaagcgcttcccgctgtctttaccgcgacggggaagtatttttatgattcgtttgacgaccttatttccatcaaattctatagtgtcctgaagctctccgccccatatattgatcacgtcagcaatacaatccaacgctgtttttttatagaaggtagtcgaattcactccaagctccgccgttacttccgccacccatcttgaccgagaaaggacgttgtccagtacaaactgagcagttttgttagttgggcggaaatcttttacaaatgtttcggcaagctccatcatggcagcctcacaggtaacctgggtgttaacctctccttcttcgtctgcatcatccagttccttgatgacaaacagacgcattacaccgtccttatccttgaataccacttgattctcttcgaataggaagcgcgcatcagggtgggaggcatcggctacaaaagaaaaagaagagcccttgttgagctcttctttgtatttcgcatcccagaacgtacaggtttctcgtccgtggctggacagcactgtcaataatttatcatctggtgaaagtatataaatgtcagccatgaccggacctccttacaaatatgcctcattaaatttgatgctgctcttatgactgaacttgattttaactggcgtcctaggcggcagcagaaaccaatctgattgaatttgaagtgctgtcatgattaaattaccgctgcaagtgacttttctttttgcagaatcaattacaagtgtgtcaccagcgatgaaatcgtacagcagcttgatcgttttcgatacagacccatcaccattaagaagagccacttcatatgaagtggctttctcttcaaagacgcattcgattgtcgggtctacggccgcatagcccggattagtgatagtctgaatacctgaattaaattcaaaatccttcgccgggccgtatttttttggatcaggacagataaaagtcaatgttgcagtctgaaagcctccctgttcttcgccttctgaaatgctttcaaagacagcattatagactctgtcaggctcatcgtgaaaaattaacggtttaggttcttcggtgtgcagaataaaagtcagttcctcctgctttttcttcagctcttcttcactgctgaaagcaaaaagaacctcaacggttatgactcttacaggaattcttgtgttccgcaggaaaccgccggggcgattcccgatagtggctgtattcacttctcttccggtcactccccggccgcccgtggacttcacataaaagaagggtgatatatcaatgccgtcaaacgtgattttccattgattaggcagcagttcctgataattgatcaattaaatctcgtcctccttgcgttcgaccttttctgagcgtctgtgaccggtttttctacgccttgaccgaccttcttgctgtccatctcaacaacaatcatcctgtcaggcaattcaaggttccggatgtccgcgctcaattcttttctaaccgtgccgagttcgctgctggaaatggatgtgtcatatgcaaaattcagatcctcctgctgaatagtcatggcatcactgacgacgcccatagctttctgaacagtgccgataccattctgaatccccacagcgataccggcaggaaccatgaccccgacctgatcccgcatcaatctggatggggaatggattttcaatttcttcttaatcgttttttcaattgtcgaggcgatggaatttgcttctttcgccagctcgcccttcatattcttcattccagaaataatgccggccattgtatttgaaccgatggcttttccgcttttcttgagagaaccaagctgttttacatccactgtaagctccccaattttgcggagatagtcatttttcaaaagtgccagttctttatttgcggcagaccgtaattcatttattttcttggtcgtcgcgttcttcaacccggttaattcttgagcagcctggtcactggccagcttgtgcttttctttccacagactgacatactcatttagctctgaatctgtcatgcgggctattgcattaatctgatcagctgacccgacacccatttctttcaattcgtctgtgaatgcctttggtgcccggcttgctatttttgtaatgtcagtgttgaacgttttgatcttgtccagctgctttttaagatttgaagtcagcttggagccgttcacattttgacttgagacatcgtcaaatagaccgatggcgttataaatcgcgtcagttcggtcttgcagctcctttttataggcatcgttggccgccttaatatcggcagtcagtttatcattcacttttttgaattttgagagataagtattgtttgcagaaagaatgcccttgttaagtttgtcagccgctttcttttcggcttccttctgctttctggccttatcagtcatagctttttgagtctgatagatttcccgttgaacctttatttgctggtcagaattcagcttgttcttcttcttgattttctcaagcgttttgatataggtattcccgctgatttttcctgtatcgtattttgcctcagctttcttaatctgatctgatactttcttggtatacgccagtttcgccttcgcttccttgcgctgctgctctttcagtagcttcttctgtttatcagaggcgcttttggatgcctgatatatctcgcgctggatttttcggttttgctcactggtcagcttgttttgcttctgaatcttctgcaatgttttgatatacgtatcggcgcccattttcttggtgtcatacttcacttcagcgttcttaattttgttggatacctttacctcagccgccttctgagccgctttcgctgcttttgccgcagccgcttttacttttccctgtgatttatcaatacctgccgccataccggtgccgacgtgataaccgacctggtcacgcattacccttgacggtgaatggattcccagaagctttttcatgccgttaggaattgcgtttgccattgatttaactttgctcgctaatgcacccgccatgccgctgataccatttattaagccttgtatgatgttgcggccaatggacttgaggttgatgcctctaaaaaatttcatgacactattccaaatgctgacgatacgttcttttgttgcttggatacggtttacgatttgcgctttcatgtaactaaatgctgtagaagccgcgcctttaatgccgttccaaatggacatcactttgcttttcactgtattccagaggcttattactctgtctctcgtcgctacaattctattgacgatttgcgcccgcatgtagttgaaggctgttacagctgcactttttaaagcattccagacagatgtcactttgctttttatcgcgttccacaaactgaccattttgtctctggttgcaataatccgattcacaatttgtgcgcgcatataggtgaaagcagtcactgcagcacttttcagagcattccatatggacgagactttactcttaattgcattccagatgctgatcattttatctctcgtcgcaatgatcctgttaacgatctgggcccgcatatacgtaaaggctgtgacagccgccgatttgagacctgaccaaattgatgtaacggtgttcttaatgccgttccatattgaagtcgcagtctttttaatcccattccagacagaagaggcaaacgattttatagcattccaaactgttgtgaaaatggttttgtacagattgaattcccacttaaaaaaagcagatagcccgttccaaatggttttagcagccgaaacaattccattccaaacagtggagaagaacgacgttattgcgttccatgttgatgttgccgctgttttaatgccttcccatacagattggagccactgagatatgacaccccaaacttgaagggtgtactgcttgaccttatcccaattggcaataatgagaacaactaaggctataaccgccgccgtaatccacccgataggccccattgcgatgacccatgatgctgccatgcgcgccgcatttgccgctgcttgagccgccagaatgaccaagcgtttaccaaataagatcatttgcttaattcctgccgccaacattgacacaaatgaactgatttttgccgcagtccacgccgctgccatacgtgttgcttgggctgctgattttgctgctaaaacagttattctggcaatgaaaagtcccatctgcttaatgccgtttttcagcattgttataaaagaaccgattttcatcgcagtccatgatgctgccattttcacagcattagctgttgcttttgctgccataacggtatatctcgcaatgaattgccctatagtaactatcgctgattttaattgggtgatcaatccggccattctaattccggatgcggcagaactgaaactccgaatatatcgagcagcagtcataaagtctttaagcccatttgttacagcactgactgctactatcgccggaacaatagctcttaaagcaccgattaatgaaatacccgccgcaatgaacttcccgattgccgggtttgcttccatcgccgcattagtaaatttcaaaaacccgtttacattctccaaaatcgttttgcctagtggagccatgccaacaagcaagttgatgatagttttcgcgatctgccccaatgtgctccatactgtagggccgttggttttaatatagtcaatgaacgattgaaattcttttgttttcgtaacgctgccagcccactcattgaaccgcttggtcaggtctacgagggatgtcatcatgtcttgagacataggagcgaatccagtaaacagctttgtcaggccgcccgaaaagtttctgataatctgcaacaattttgggccgttggtttttgtatactccacgaaagcctggaatttctttgaggagcctaagttcgctgaccatttcacccatgattgcgtcattccttcgatagactttgtcatgctctttccggtcggtccgaatgctacgatgagattgaaaactgtccgcaagacattcccggcagatcggccgaatgaagcaaacgccttcggagcttctttgttcagataggaaatgaatctctgcatgtccggagccttgaaagccttgtccatgctttttgccagtcccacgccctctttcgccagcccgtcaaacattggaatcagtgagttaagcgcgagtttgaacgtattaagagacataccgaatgtttttaagatcggcttttgaaccatcgtaccgatgtcccgccagttgtctttaaagtcttcgaggttctttaatgcctctctctcttcttttccaagagatttttgcagattattgatctgtttcatgattttagcgcgctcttttgcgcttgttgcattgtccagcttctcctgtagcttggaaaggtcttcggatgctttgaatacaccgcttatcgaagtaatagcaagggcgccgaatgccgccgcgcctgttcccgctgttgcaaatgcactggttaaccccattactccgccggctgccactccgagcatagggcccaatgagccgattgctccgacaatacttgcaagggctggcgagattgcaggaagtagggacgttaatgccccggcaattgaatgaccgatgaccgttgaaactgagtttgtgatcttggcaagcctgttcattgacgtttcaaaccgatcaattcgagcttctatactaatccatactcttctcggcaaggacgccagagcagcgcgtgccgttgccacagagcgcataagcgcagccgtgtttccgtttatgaccgtggtaattctgtttggcagtgaagccaaagctgaacggacagccgaaaccccgcgcatgataggcgacgtggccgcattaaaagtggtagttacgttatgagatactgatgctatggctgaccgcgcaacagcgacagcacgccctaaaggagtgggatttccgtctatcgtcgttgtgattctgttcgccaccgccgatagccctgctttagcgcgtgccaatgcggaagataacggccgcacattccccattaattgcgtggtgacagtttggggaatctgtcttaatctttgcttcgcccaattgatggcccgagttaaagggtctgaatccgcatctaaatcaactcgcgtgcgttgatgtcgatgaacaaagttatctatttgttgcgccgcctgccgtactcttgcctgaaagctggcaatctcggcgtcaacctcgactgtgtgatgatcagccatccggcgcattatatcgttgacacgatccatactgcgattaaattttcttgtctgtgcttcaactattgctgtcagtctttcgatcattccctcaccccattccttgtccgaattttgcaaagtggttgcggattgcatcattaaaccgctgaacccctttggctcgtttgccgagctcgtttacatctgacttgcgccatttgtcgttatcgccagtgatattgcgctccaattggcgtctggccttcttcgcatcaaacattttcgtttctttggggcgcttctcattcatggcgtaacgatgaaacatggcgtttcttgccataagctccaattcatctatttctcgcaacttggctcctttgagcagaagcttgtactcgttaggagtccatgacatgattaaatccacatcataaaccccgagccaatgtgcggagttcgtaattatttggtcgtagtcgatcccgttctctctttgtatgcctctttcatcatcttcaagacttccttgccgttctcttcgtcctccaaccgtttcgcttccatttccggtgtttcgttcggagctggtttcttccctttgttcatcttctccatcatcttccaacgctgacggattacgcctttgaaaaaacccgctgaatccagtgttgtgaatgcttcattgatcatcttgtcaattgcgtcgcctgtctcgtcttcatcaatgattttcatgattgcttcttcaatagcctcagttgatggcttttctttcttcaagtaagcgagtgcacaatcccaaaaagcagaaagataggaagcctcttcgttgagcagactcatgtaaatattcattgtgccgcctttgcccttttcgtccgcagtggaatatttttcgtttgccaatctgtcaaaagcaaagtcgcagcgtgatttgtattctttatctccgatagttaagtaagccatttataaaacctccgattatttttgtatgttaaaaaagagcccgggaagcccggaccctatgattccttttctgttcgtatcgtaaaattggccgatcgttccgattccccagccgagttcactgccgacacattaaaaatgtaggcagtgtccggcttcaggttaggattcgacgtgtacgaattctttgagacagtcgctatttttgcataaaacctgtaaatattgtaagatgtcgcccctttcaccgcatcccatgaaaaactcacctgatttgaagtggcgcttttcgcagttatattgcggggaacgttagggcgtaaccgcttgtgtttgcgtaacaatctcagtcattgaggactcacccgcatcgttcacagcagagacgttgaccgtgagtttcgtatcggccgcaattcctgtcaaggtgtgggatgtgccagtgacagttgcgtccagctgcttgctcgctcccctgtataccttatatgaagttgccccatctaccgcatcccatttcacggtcacgctgtcagctgtagccgtgaacgatagattttggggcgcattagggcgtagttgtttttttggcattctcgccaaactgcatgaactctttggcaccggcagaagatctgatctcgtcaattaattcttgaggcagaggatcaagttcacctttacgggtcttaccgagaacaggcaatgttgttgaaacctcaataaacccatcttgcggtgcacttttttctaagttctcgatgattgcatgtccatattcagaatcatgcttatcgtttttgtttttattcaggtttactttccatacctgaactgtctcttcgttgtcataagcatcttcaatcgccgtttgacccggatcagagacagcagcatagtatgtcagttcgatgctctcagatttagggccgtacccaacaattcggccagactttgttgattcatcttttgtatcttgttctttcgtatgactgccttctgtttggaatgcgataaacagaccttcagttgaagtagcattcatcggttgaacaaagtaaacctcatcaataccattcaataaatctgccattttgttcatcctctcaattgtttattgtgaagcgcattctgagaatgccgtgacgcgtgtacccgtcaatatcggtgatcacctgcatgctgcgcaactcagaacggcataaagaaaagccctctattgttaggggcctgcttgttaacgcttgaagcatgaggctcaaaatctccatcgcttctttttttccgttgtaacctgaccagcagtgtaaaaccacattgatttcttcaccgctggatgtcttggttttaaatggggatacatcatcatcgcccattgtcacataaggcttttgctgatctttcgggactgcatcaaagacgcccgtgacgcgcccgttcagctcttcgtctgttgataacctcttaaataaagcagcctgcaacggccacagggcagatcgcatgatgacagctcctttctatcacatttgactggcaaaataccgcatgccttcgtccaccgctggattccagaacggctgtgcccgcattccccgcgtgaccacccatctattaagcttggtgtcataataaacccacggcgtttgccggccgccgccttcctctgcgtaaatccctgttccgtattccacatatacggcataatcggcaccaacagaaataacggcccgtaagccgccctcttggtagtcgatttcaattgaatttttcaagttccccccgtctattgcggcggtcggagcattcagaacagcgtggctgtaaatcagctcggccgtgtctgtgaccagttgcttaatatcatctatgacccggcttctgaactcgcttgtggctctttgcatctgcctgacccatctaccactgacctcagccattgcccttcagcacccccgtaacctgacatttcaaattcataatctcatgcatgccgccctggtcgatcggatctgatttgagagtcagcaccttgttctcgtagatgatccgcattgtcttctcaatatcattgcgatacgggaaatacacattgaaatcaaccgggttctgaagctgctgagcctgataatattcccgggacgtaatcccgccgacaaaggcctctattgtgagataatcagtgaatttttcaacatagcccccgccgccgtccggcacctcttcccaacgctgaaatgtaacgatatgcgggaattcttcatagatcatatgactctcagctttctgtatggagcaagaagcttcgtaatgctgcttggcagctctgtttcataagaatatgagacatctcccatacttcggcctgaaaggttggaaggagtcatgttatgctcgatcgctttcgcgacatacagctttacccctgctggtaatttttcatctccattgaccatgaatgagttgttgcaccagtctttcgcttgatctatgaacagaggtaggacctcggccagataggtatcgtggctgtctgtttttatgccaagcatattttttacggtttgaacatccatagaatcacctacacttcaccgagaacaattttgatcagttcctctttaggcgctttgggatcaaattcatattcgttctccttaagaaaggcaacgatttcatccttattcacctttttcaattgctcttcagtcatatcaagaaggtttgtacccggccgttcattcagctctttagattgtttggcctcatccactctcttaaaaccaatgtgagaataaaccacctcaaaagccttttcagtgcattcaatagttttggaaccgttagatgctttcatatcacgcgccgcctccttccagtgcttttatccgattctctaaatcagatagtttggctttcacatcgtcaccgagtttagctaaagtaactgccttggcaccgatgttggcattttgtacactaccagtgccgatgttacgattttggacagaacagtcaccgatattgatgtttttcacttctccgtcgccgatcatttccgaagtgatagttttaggagcaggcgcagaacccgataacccagtcaccttcgcaccctcttttatttcgagctcgccgccgatcaccaatttgtcgccgttattagtgctatagtttttagatgtgtaccccataagcttacgcctccgttgctggtgtaatagcagcaaaagcatcatcggtcagtgtcatgaatccgacttgctgagttacacggagagcaaccatatctctctcatacaagttgatcgggtttccgtctgcatcgacaatcgttgtcaatgttgcatcctctgagattttgtattccatgccttgagggattccgtaacgtgtgtaattccagtcagccgcaagtaatgccgctttttcgtaatcccatgacttagaatccacatatccgatcggaaggccaagggcttgttgtgtggcgccgcctgtcgcatcgttgaagatcggaaggccgttaccgtccttagtgccgcggagcttttgacggaatcggcgtgttgttgtaaagccgtttacatctttgtcagcgtcttcaacaagagccatgaccccgtttaactcatcatatagattgccaagtgagtttaacgcaattgtgttaccagattccttgattttttcaaatacagatacgccttttccaaacggtgaatctacaccgaataacgcagcctgatcaaatttgatcgcaaaggcttcagcgatagcagggcgcatttgtgtgaagaaatctgttacagagtagcgcaagaattctttagaaacagggatgatgacacccaatttctttgaaatcatttttgctgttaaccattgagccttagaagtttggattctctcgccttctccaacccagtaagctcccggtccagaagccaagtacgtgaattccttctccggcttactcatttcttcatattttgctagttttgtgacagcagattgggtcataaactcttttaaaaccagcgttccttgttcggttggaaccttcccatttactgagtcttgcattaatgcattgtttggattaaatgttggcattaaaaatagccctccttattttctaatacttgcttcagctgcaagcgagctgatgtctaaatcttgatttgtcggttcattgctaccggactggacatcacggccattctcttgaaacttggattcaatagccttttgaagtgcagcattgtacttctcttcgaatgctccgaggttcttcatcgttgattcttcatcctcaccgataaagaattccactacatctgccggcagttgcttttcagaagcataagaaacagctttgtttaaaagcttttcacgttgtgccgctgtcttttgatcttccagctccttttcgagcttcctgatccgcttctgctcttctgtttcttctggataaagctcttttacctttgcatcaatcagagcatcgaggttgttcgccttccacgtatcaagaccttttgtaaaatgagaatccaaccgaggctgaatgagacgttttccttcttctgtatctaaaaacccattcaccttgtcagcagacacggcagaaagttcattcagatacgcctttacatcttcgttttctttattttcttcgagaaattttttcacatcttctaaagttggcattacgcttcttcctccttcgccctctacagtgcgcgcctgttatgagtgcatgaaaaataagccttttaacgtcatgctcaggacaaaataaaaagccgctgtttaacgtcttcccttttcctcaatggatttgtaccactcttcataggtttggtatggaattgtttggcctgccccactgccgccttccctcgcccttctcgtatccggcagcacaccgtttactttaaaagcaatcgtacaacggcaatttatgtcatctttcgcattattcatgtgccccggagccggcccgactccgccgtaaattgatttgaacagcccattgcgttctattgtcttcccgtccagtttcctgtgcccggctcgtgttttaagatcaagagtagcattccacatctttttaaggttgctccgttttgaggccttctcagcgctttccatcctcgccgagacttgtaccctatgagcttctgttctcgccacgtcacgggctttcctgcgggcaaattcggtcgctctttcaatgcggcgggcgatcttggaataatcctcccccgcttgtaggccctgtgcgacggaaatttgaatctgccggacataatcgtctcgatgccgcctgtaaatagctgacaaagtcaattcagctatagggtttagaatggcctgccgaatgacttcggctgtcgggatgctaaaacccaagttaaccacggattccatttcaaatagataagcagaacgcatataattctctaaaaactgcttggctgctaatgcctcaacaatagtcagaatggttttgaaagccttgtgagattcctcggccatcctctccatttccttgttcagacgattgtatttgttggcatcggctaaagtaagctggccgtccttgctgtacttcgcatacagccgggcaatttgtgcgttgatctcctttaagcgagacgcaaaaacgacatcaatcttctgagcatcctcagtgatcatgtcgtccaggtacttatcaatatcattctggttcatcttcatcaccgcccgcgtctgtttccacatccgttaacggcggcatgttgagcctgtattcctcttcttcctcttccatcttcttcagctcatactggacatcatcaacaaacgacagcagagataggcgagtttcttcgcttaccattcctttaagttgccctgtcgtttgtgcttcttccagtacatttgccggaaggtttcgcttaaatccgaaccaaacttttttataatcttccgctgccgctttccttttagtgccccatgcggaaaagatcagtttgtattgataacgcagagcagcagtcattttccgctccatcgtgatgcatttgttttcaagcgacatcaatttatatttcatcgcaacccctgaaacattcccaccaaaagattcatcggagaaattgaccgattttgcaaagcgaaggatattctcttccaacctatcaagatggttttctatgatggcatcgtttatatcctttgtcagatagcttacgtcatctttttcgtcaagcaattcaaggactccggtctttttgagctggtcaagcgtctcttcatcagcgcccaacccttttaaaatcaggtatgccagccgatattgctcaatctcattcgatgcatcggacaacgtgcggtcatacgcatcaattaacgaaagaaccttttcagcatctccctttagttccttgttattcgctaaaccgaataaggggcagccatcaaaaagatgcaatgtttttttatcaaaagtgaaggctgagctgtctttcgtactgaaataatagacatatttctgatcatagaattctgctttgatctttccgccgtacaccgtgtaatatcgcaaagcataagcaggttcatggatacttccatcagtaataaaggcgcattcccatggatcaatattttttatacgctcgtttccagaacgatcaacgtaagcgaggcgggcgccgtaaccgcaaatagaggccattttcccccactcgctgtcttcatcagcaatgttattttccatattaaaattttcgatcaactgttttacaggtattgcagtgcttgtcgtatcgctctcatcaaactcatatgcaatagggtggccgaacaaatagcccacctttgtatcaatgatttcagagtcaaacgagttgttaagcctattgtttactttgtgatcaatacgttttaattttcctgtttcaaaatcttcgtattcaatggcttctctggataagatcggaacgccttgaacctcagcctcgtaccgttcataaagctttttcattctgtcatgatccggcttatgttcctgaatgatcttgtcaatcaattcaggcgttatgccggactgttcaatcatgtctataaaatgattcatcagctcacccctctccgtcttttcggtttattatgcgaatacagagcgtaccggagtgagtccagcacgtcgtcccattccttaaccggttcgcctgtcttctgattccagacgtacataaagatttcttttttgaaccggtcaactttgtcttcaacaacaaaaagctgttcttgtttgaacagccgcgctacttcttctataccggatacgacagctttatcagcgttaatagcccgaagtttttcacgccggaaacgaacaacgtgttctggtcgtgccgtatcacaatagaaattaatgtttccgtaccgctcttttacgcctttcgctaccttcacccagtaatgaatttcctcatgttgcttggcatattcttcgagcaaataaaaacacccctggtcatcttgtccgattacaacaatagaacccgggtgctcatatccccagtcaacgcccgcaaaatacttcttgaaattgacgcgcctgttttccaattcctcagagctgatatagtggatgtccttattgaaatccttgtatatgactccttctggcgccacccaataaccgtgtatatcccgatctgtaaacatgccgctcggcgttgatgccacgatgctctccacatattccggatcgagaaaattgttgtcgaacagcgagaaatgaaatgacctgatgttcagccgcccgcttttcagcatttgcccgtctttgtcgatataatccgttttgacggtgtgcatcgggttttcgggatttgtatccatcatgaccacagcgcctttatacgagcaccgggaaatgacttctttcacgaatgaatcgtgcagggcagtcgcttcgtttaggaatgcgccggctgatgtgaacccccgcgcttttttccatgaatcagcattggctccatcaaagcaatatacacggttgccgaatatttcaacggcattcgacttgtcgagcctcaattctttacccagaatcagttccatatcgttcaagacatttcgttttatggctgcctgagtagccccgccgatgatgaaggataaacccatattttgatacttactgacgtgagcaaggaacgtcaaaaggagcacgaatgtttttcctgccctctttgcgccgctacaaattagaattttgggttgctctttaataaagctgtcccaaacttccttttgctttttattcagttccatcggcattcaccatttttctcaacattgcagcaatatcattttcttgggtgtttccatcgccgccattaacggtcttcttcgttttctcgatattcaagcgcatctgttccaatttaagacgccgctcatcttgctcatgcgccagctggtcaaattgcttgatcaagctccggagctcccccattgcccgagattgagcgtttaagagagtcgcatgacgatcccaagcgaactgtatttcaagttcttcttctacaatgtttttttcatatgttagattgccatcttcgtcctcatcttgatgataagcgtattttgcctttttaagctcttttgccgtatcatctttattctgcacaaacataatgcgctgcgcccgaataatagccgcatattgtatctgaatctgatcccatatcatatcagcaggggaacgctcctgaatctcttccatgatttcaagcgtttcttccggcagatactttgagaagaacccatgtgatacagcattttgatttcttgccggagccgccccgccgctatttcctaatgcgtttttgttgccgggttgcccgcctatttttgtgtgcacacttttttcggtgggtgcaccctttttcctttcccaaccatgccgctgcttccacgatttgatggtgttcactgacaccccgtatttttcggcaaggtccttgtatttcacgcctttgacgtaatccttatacgcctgaatgtgcttttcaaccatctacattcaccgccgcccccttctgattcgtgtttgttttggaaaatatattccctctaaaccgacgccgcactcagaccgttaaccacctatagttttcctgagacttaccggaaccggtttacaaggaacaaaaaaagcacccttaaaggtgcaggtgctggctttcatttgattctatttctttcataagcgaaaatataatatcagccttaattatataattcattggatacttaataactggttgctcctctttctcacaatttatatagtttactatttgagctgtattaataccaaccaccttattattataaataatggggccgccgctaaaacctccataactaaacatattgcccataaaatagtttaaatggttatggaacaaagacactttgccaaatgaataaataggaagatgctgatttgttaacataggattgacgacacctaaatcagaaaagtcaggataccctatcaaacatagatcatctcctggcgttaactttttatcagaaatgtgtttaaaatccaaaggtgtataatcggatgattctaaatttctcttaaattcaattgtctcattaaaattaagtgatataatagccaagtccatctcaaagtgattattttcataaactacaggcgcctctccagactcaccagatcctaatcgatatatttgatcgacccctacagttttgagattctcagcatatttgtttgctttgtttatagattcatggagctttcctgaatttctattcacaattagatgcttcacagtaataagatattgcttattaccttttttcacataaagagcagtaccaaagtcttgtttatcttcactgtaacattttaaatgaacaattgatttttctattcttttcaaatccatatttctctcaccacttctagaattaatctgaataatataatatgaacaaaagtaacttaatgaaacctatccttttttcttctgtttacttgccttccaatccatatactcatggaatactgtaggtcctgtcacatcgtattttctaccaatccgccacaactcatcttgcatatctttttcaatatcttcccatgatctatgcccttgtttctctaaaaaatcattaaattcttttaccattggcatcatattctcacctcccaccttattatcggttaaggagtgtgataaaggaactatttgcaaaatttgtcgaacgaaagcacttttcataaataggtggcaaccgtaagacaaaaaaacacccttttaacagggtgctcatttccgcctatgtttttggaaatctaaaatatcctctttcagaaaaagcctgtcccggggcatttctttcatcggctctaattccccggtctttactaactggttcagatactgacgggtgaaccccaatatctcaagcgcctcacttgtattgagtatctcttcattcaggaatttcttgattgcgtcacgctctttaggcttgtacatttttgaatcatccttttttctcacgatatttcaagtaaagggaaaatgctttctcgatgatcgaaacaacaaataaaatgatcagactaatgtcgagagccgttttcaacggtcccgctgccacatcctgacggaaaaacagcatatacgccagggcgagaagaacaacaatatcagtagtggactgtacacttttcatttttttgaaagtggctggctttcaagtatttttctttagtcgccgcatttgctatacttggagcaagggagaagcgctaccttctccctcggctcaaaatcatctgcgctttcttggacgtctgcgttttttgattttgggcttttttgctttaagcttttccctgatgatgaggactttctcaacaactgtgagagttgtgaggataatccccagtaccaatgcgatttcagccactttctttccctcctttctatacattaattatacatcgtttatttactcacgtcaagtaatttagtgggcttttttcattatttctccaataaaaaagagcctattcacgctaaacagaataggctgtgatctgctctatttttcattttcaggcgggaacgttcgatgttcttctgcacagttccttttttaatccccaataactgcgctatctcttcgaatgacatgttttgtacagcatgcatcatgaaaatgtctttttctctttcggtaagcacggatagggcatcagcgattctttccttatcccaatcacttacttctccctcagcttcttgaacgattgcgtattcttccggcagcgcatcaattaagcgaggttcagcaagaatcgtcctttgatatgcgtctcttctgtcagcacctcggcgtgcgcccggctgtcttccgttctgcagccattcaagagtgaattcaatatcgctgatcatgctactgataatctttttgtcgttgatctgttcagccgtcagattgacttcagccgtatctttgtagagccgatacatttttcttgtttctcttaaagctcgtttgtactcaatgattaaatcttgcattctgattcctccctttatttgcgcttaaatgcgccgcccttgcctcgtttaagtgtttgcatgtttgtgttcatcatttgttgccagaaacgatctgagcgctcctgcatgtttttattgggctttttctttttctgcttcatgtcatccctccgttcaaataaaaaacggacaccaatcagagcacagtgattctgtgcaatgatcagtgtccgcaggctttccgtcttggacttattcagttaaagcagcacatatgtagcaatgttcccgatgatcgctactatacaaattgcagttaagtgatttcttagctgtgaatccttatcctctcctataactcccataagagagactatcaggaccagcaagagagctattttaaaggctattaacatctctctcctcctaattaagacccatttgattcattccggatttaacagctagaggcaccacgtccgccggctccacatatggattcttcttgtattcctgatagtaagccacaatcagctttgacgtatggctaacaagctgcagttgtaaaggcatacccttttttaattcatcaacaatcatttgaagttcaatctcagaaaatccgttcatttgtcttccctcttctctatatacttatcaatatcttgaaaaaacgccgcggccgtgaatgcgatgattgcgcctattaacgtgatgtttgctttcatgtccggcctgtattcgtactggaaataaaaccagaaacctaaccccatcagcataaaaactattctcagcgccatcgaatcccccttatttgatttgaaattttgctgattcaaatgttccgatatagttccacttgccggaatcagagtagcagtccagctgaatgacataggtccctttcccggtcttattccggatcgttttcacgttgaatgatttcagaggcgttgccgttttgaagctgcctcgctgtaccagattcgtttcagtaagcccgccgccgctacgcttcttgtatacgccggccgtgtaataaagagtgcttgagccttttttctcggctttccagtccaccgttgaggcgccggccgtgtaagtcgcggcatccgtaaacacccggccgctgtacccggattcattttgccagccggaccatgctgcggaagcagacggcgcaacggccgcggctcccataagtaatacagctgatagaatgattgatttgaatagttttttcattattttccccttcctagttcacaaataattaacatttatttacaaggataatcattattttgctcgaattattactgtgttcaataaaaaacctaaggagtgtttaaaatgaatttcaaaaagactgctgttactgcactagcgattcctgtattagctttttccattagtggtatggcttccgctaaggagataactcctcaaaaaaatgaaacgcaaacaactatatctcctggtccaattaaagcctattacgatacctttgaagtgagagccgggggttctaaacaattagatgccaaatatttaggatcaggattcgcttatcattcagataatagcgctgttttcacagtagataccaatgggcttgtccgtggcaataaagctggaaatgcatatttaactatattcaaaaatggatcagtatacggtcagttacacgtatttgtctattaattttctaatagaagagcattctaatatgctcttctattttccacttcaccacctatgcagcgcccacaatgcgggcagcgggcatctgcgcggatttctaaatcaagttttttataatctcagtccgggcaatgatattcgatcatttactatccgcccattcatcaaagctgtaggggtaatcaacactttcaatgaaaccaatctccttcgccttctgacggattttcatacatccttcatagctgtaagcccatatttctttataatccctcagctcgccgcatttccctgttatgatgaattttctgaagctgttgaccagttgccacatgttgcccccatgcgaaaagccgtttgaactgccgtatcccaattcatacgggtaaacatcagcgcccgtgtaatcatcaacgaagaacagttttttcttaaatctgaaatacgctatgcgatcctttgacttgcggtagaatgtacgatgatcaatgcttgcgataagcttgatcaaatcgtttatgtcgttcattcgtttcaattgctctgctgttggcattgggttccctcctgatcaaataagctgagttgtgtgattttatagttaaatagcaataattcttcagccccgcggctttttccggatccgccgacaacctgtttgtatgcggaaaaggtttctgactcccagttcgggtagatctcgagtatcaaaggatcatcgtaataagaaagaaccactttccctttgacctgattaagcagccgggccagttcccgatgatcctcttcgttaaagccgccagcataaaaccgttcacgcccaacatatggcggatccacataaaacaaagtatccgggctatcgtatttctcgatgatgttacgaaaatccttacattcgatcatgacgcccttcatacggttggcgaaagactcgaaggcagcgcaggcgcttatgtatccgccagcagggttctgcccgctttgtgtgctatgcctccagcctgtctgcggcacttcctccacgttccccttactaatgccggagcgattcatataaaaccacctgacagcccggtcaaaatcattttgcgggtaatcttcagttttccatttctcatagagcgcccggctgtacggaatggattcgcaagcctgctgcatggcctttggatcctttctgacttgcatcaagaaattcaccacatggccgtcaatgtcgttatacacttcatgtcccatttgcggcttattcgctatgacatgagccgcgccgccgaaaggctcgacgtacaccttatgggcgggcattttatttatgatgtgatcggcgtatcgacctttgccgccaaaccagattaacggtgagcgtgccatcccttaacccccgatcaaattcggcagcacggagatagcgaagaagaaaagccccacgcatgccccgaccagccagatatttgttttatcccgtttagcgataatggtatggtcaccgatcattttcagatcgtcagaccgagcgaccagcgtcgggatgtaatccgggtgaacctttaaaagctcggccgcctgctcgacggtcatcgcttcgtccttcgtggccttcacgttccgttgtagttcgacttgtaatggcatcattttgcagcaccgcctaacatttcgggattctgatgtacgttgccgattaactcaccatacatttgaacaaaatcccaacgtattccacccgcataaaatccggcatcatcttctgaccatttaacgactagattaaacacccggccgtgtgatttataacagataatatctcccgcatatatttctttttccataagctttttgcccgtccataaatcgcggctgatcaactcgtaaccaaactcttcacaaaagacgggagacagtttgcgcgccgggcgttcttcaagctgactgatatagtacgttttcaattcaacattgcctgtttccttatgtcggaatacgtatcggatttttatgttattcattccgcagccccctccaatgcttttctggccgtttgccctccgtcgagttcgacagcaggcggacagtcttcaaattcgtttgtatacgtcgtttcattggcgtaaaattctaatgcgtttctataacgcttgttctccgcctgtagcaacttaatatcttcctgagcctgccgaaactgaatgaccgtgacatcctgctggcgctggtgctcccgattcatagcctgttgcatgattaactcttccgcgagcttttcggctgctgcttctaaagatatttgctccggtgtactggccgccgttttcgaaagggtgcaaatgtaagagccggtatataaaacctcaccttttgacaagttgattttgaattctttcatgcccgggcctcccggtctaaaagacatgttttgcatacaacccattgagctgaataatatatttttccgcagcgttcacacttgcgggcaatttcgttttgatacattttccgttcctcccccgcaggggaaaacccctgctaattgaatttatggccgatctcgtaatcacaacgagccaggccgccttttattgtttgaatgattgttttaccgtgttccggggcgtccattagatgagcagtcccttcagtgccatctaaaacgatgatgcggactttccccggctcgatgctttgctgaatagttgtttcatgattttttatttctgtcggcttgttcactctggccgccccctgtgctatgatagaagtaccagttcatatcagagcatcggggccacggcttcggtgcttttttacgttttacgacggcagccgcatcgttactccggcagatggttttaattcctcgcggtaaatgatcggatgcttttcgatgtaagctgccaattgctccggcgtcattttccacttcttaactggaccaggcttgtatcggttgatttcttcttgcatagcgataacctcctgaattgatttagttctcaagcatcaaactttctccacaaagcgttatggcaggatttccgttataatgacttccacccggggctcttcactgtaaaacttgctaactttcagatcgactacctggctatcatcccggtaaatcagatgattcagggcgtctttaactccctttacatagttgtcaacgtccggctttgttacgggacgcaggagacccttttccgcattttctctttttgtcttggaattagaaatttctttcgtcattggtctgaatactctgacatccattgccacaggtcccgtaataacttgttttggccgatactgtgacgccaccagcgcaacatattgtttaaaattctttgatttcaaaggatcacgcattttaaccttgccatttataacagatcccctcggccttccctgtgcaacaggctcgccgtaaactataaactgaatggaatccaaccgtcattacctcccgtcaatttgttcccagtgctgaatctgcttttccttgtacggcgctgtgaggatgatggccggcagcagtataaccgctttaagcactgtgcatcagctccatttgtttgattttttcctcaagcacccggatcgccggggtaaggtcctggccggccgtttgctcagcaggcccgaacacgtacatgccgccggttgctgtgaagttcgctttttccgtcattcccaatctcctaacctatggtttaattgcatccgatcgcccttgatggtcactgtgtaatctctgcacatttgatgaatgcgggagcccagcgcctcgtctatgtccaaaatttcccccgtatcaagctcggaagagattagcagaggcttatgattcaggtaccgataattcacaaccgattgaatttgttccacttgccaatccgtcgcccgcggctccccctttactggtttgaataagtcatcaatgaacagaacttcagctttccgcatagcgtcgagctttgtttccagctgatcaaagtcatttcgcagatcgcccattccctcaacgtacgggaaatacatgcagtaaattgattttttcttaatcaggttgttcatgatcgccgttaacaagtgcgtttttccgctgcccggctgcccgagcaaagcgatactgtttgaacgttttcccttgatgctctgaaaatccttatagtattccaccgcgcactcataagcgtccttgatcatatccggcttcccgtccttaatgaagtttccaaaaaggagcttttcgaattcctccgtgatgccgctggccttcataagccgggcgatctttttccgcttcacacactcgcattgcttggaaaatgtggttttccattctcgggccttatccggcaagcatactttccccgcaagataatcctcttctctgaccatttgatcaggggccaggctttccattgtcttatgctcttttctcaattggcgctcggtgtcttggtgaatacggtaaacaataatgcccttatccttgcagtcagagcactcgtattcagccttttcttctgaggcggcctgtcccgttgaagatgctgctgaccgatcccggagcttggttagaattgccttcattgccgcgtccatatcttgcgttttgcgagcttccatactgctgtttctcctttcgtctctggctgaatgggtttgagaggatggcttcaatgtaattcagattgacgttgttgcccttgaatctgaaagcctgtttcattgcctccatgactttctcttcaccgtaatcatccaccatatatccgagccgctgaacctccatcgtgccaatggtgcgggctgttttgttttcgaatagttcaaatgcgtttttcattttttcgtcaacctcctgctgtcctaaaggtattggagccgggtctatcttcttgttgtaatttccaagctgtatgtactcggcataattcaacaccgtcacaatgaaaccgcgtttttgcggcagccggtccagcttcaaatactcttgctttaccatccgatctaacgagtatttgatctgatcagaagaccagttgaagcgcttggctaaatctacaagcttaatgattgtctgcccgagctttagttcttgatctgccctgtactccgcccgtttgaataaataatcgtatattgtctcgtctcgtgaatctttaaatggcagccggggcaggaccacataccccaaaccttgcatatccatgccgctcacctacttcctttcacacagtgctgtcagagccttgaaatctacttctactaatctcagagacggctcatttgtctttaagtagtcagtcgtgtaccgggtatacaagtcctttctcaagtcgcgctgaaccgttttgaccagccagagataacaatgcgggataggaatcctgatcagctccctttccatcagctcaccaactccgaaaaatggatgatgctgttcagttgattagtggcccggcaatacttgcatttttcgcatcgctctggtttctctccgccgtgtttcacttgcaaaatccgatccatccgctgctcaatctcttcaagctctatttccagcctgccctcatcaatattgatgacagctttatcaggtggatcttcttttgaaacccctacgatcaggggctcaagccattcgctccgtccagtcatccgtttttcaatctctgcgtaaagcgccatctgagcgatgtatccgtatgcctcaacaaaagagcaatatcctatttccgggtcccaaactttctcccgcaatgaccgcgctgttttcagatcggagaaacggccgccagctgggttgtatacgtccagctttcctttccacggaacaccgaacaattcagcagttacgatgacttccttttctccttgaagaacaaacatacagagatcatcattttgaatcgcctcaatcatcagatcagctaactgatactgcttgtacagctggcccttttgtgtaaaaagtgatggggtgttctttttaaattcatcaaaagcctgttcaccctcaagccaggcatgaacgtattggccgaagaggagcgcctccgatgtgggcggcgtccattctccgttcaactttgccatcgtggcagcctcgcattgcaaaaagcttttatattgagaatttgacatgtagtgtctatcaatctcgttagagtaataattcttcttgttcagcgccggtatccgcattagcaggatcacccgccttttctttactatcagcaggcttgtcagcttgctctttcagctttttgaattcttcttcagcctttgatttagtcgcgctagtggccttcacattgaagtaatcctctttctttgccatcccatcacgcagggccgtgtaaatacgaccaattttcaggaaatcttgctcagtgaaggcatcaacattactgccgatgtactcctgaatcatttccttagtgatgccaaactcttttttaaaaagggagaaggcacttctgagtcggtcttccagtggttccttatgtccactaatcaatgttttttgacacatatctaccgccgcatcaacgatgtcgcccggaatcactccaagtatgcaagcacgaacccggcgggctccttgattggcaaccatttcgtaaatatcccttggatcatcaagtttggtaatggcgccccgtgccttccgttcatgcttcacagtgaaaattttggtttgccgggtattcgtttcaagatcccaagcgtaagccatgacagatgattcaccggccttttgttccaactccataattccgtaatcaatgttcccccagttctgtgccaaggcctcagccagccggatggatgggccggaaacctttgtgccgccgcgcggatattcatataccgcattctcagccaatagcctccgctcgcatgcttttttaatccggtcaaaagccgcgtatacgtcccgtgggaatttctttgcgataaccattgccgcttgtacttcttgagcctgtcggcttaccatcgcttccatagtcacgccagtagcctgctggggcgccggcatgtaatctgagtaatccacctgtgataatccattcattgtgcttctgccacctttcttttatatgcttccgttccaagccgctgccattcccgatagtgatccattgaagggaaactaaactgcgctttaccgtttttggagaatacaattgagccgccgacctgccttaaacgtcgctgatcctccgcacgctcactgaatgccactttaactgctttagccatgtataaaacctccattgttttttatggggcgttttggtataataggaatacaatcaattatcaaaacgccttacctagtccactctgccaagtgggcttttttattgctcatttttaaattcaaaaccaagatgctccttcagataccgctcaaggttttccctcaagatgatttcaccctcagcactatctatcacgtaatcatcgaaagccgttacttcatccccaaagtaatccttttgcgtgtccggctcagtcagtttgtcatgccagttgttcaagaccatcggattttcaatattcattgtgaacacctacttacaacactcaggtgaatcccgcgggccgccatatttaagacagtttgatgtaagcgccctttattcgtcagccggtttatatcctctgtaagaaccttgatgctccctgcaagactgatagcttcttcataatcgccatcccgcaacgcctccgcaagcatgatagagagcctttccgccgactcgattttcctttttgctgaatctgcatctgctttaagaaactgattgattttcataccagcaccgcctgcctttcttctgttttcgccattgcaacctgactcattagcgctttccgcgtccacctttcggccagttccttcatgttcagtccatgactacgggccagcgaatatatcagcgttttatttgctgggatcagatcaaaaatctgctttatatcggccatgggcagttcttcaggttgtcggcctggcctatcgtttgccaaccagcgcgctaaatgccttgttgcttgtaatgcttcttcaagctggtgaatcatattgattaccgccgcgcttgcactctcgttaagtgctggatcaattggcgccgccgtcgtcgggtgcaatttgaagagataatgtaccagatcaatatgttcgtatgcctcgcacgcctcaaaccacttaatgcataattccggggtaagcttactgaatccattttcaacgtccgaaacatatcgctgatcctttccccctatcaaattaccgatctgatactgtgcaagtcctgccgctttgcggacactacgcatgatccggggtagattatgcaaattgtatgggttgttctccatatgtttgcctcctgatatatccagttgttcactggtaaaatttaattaatgaagggacaagctagtccttttctcgaacattaatctccccaaatttgtggagattgtttcaagctgtttctgatgaaatgaatttattcacaaaataaatctgaccttttcccgtaacctttggcgttcgggtagttctaattgaaccatcagggttattcattgttctcttcttaatttcaaagagacccaaatccatacttcgctgtgttggtagattgaaagactcgcctgtcttacgaattaaataaccattatcacggagccattgaaataacttgttaggtccaatctttacgccgttctgttgaatgattttcgctaactcgccaacaagcacagatgattcagatgcttccacggcttcggcgaaaagagcttttggcttcatagattcaatttgcttattttgctcctttagtgcgtgaagagttgttttgaaaaataatttggtattttcgtctgcgttggacaaatacgtctgaatgaactgttcatcatttgcgacatatcccccggtttttctgattgtgggtataacttcaaaggctaaccaatcttgaaattgttcggcaatttgattagatgctctaaaagccagcttgtacaccaatggttcaggaataaaatcacctttctctacttctggaaagttatccggaaggtaagtattcacacggctccatcggattgttacgttgccacttttggcaacggtagtgaggcctaagttccgagcaacttgctcggcatcaaaaaggatttgatcattctcaattttggctgcaacttcgaaaatttcatttttgaatgtttgtaaattattcatgccgaagctcctttctgatagtatgcggtgttctcagcaacccaacgcgtgttgctctcaatccatttaaaaagcaaagtcgtagggatttttttgccacattcttcgttaaccggaaaatccggacgggccatcagttccgccattttagtgggaccgcaccgcagcacctccatcgcttcagttctcgtcaagatgtgaggaagctcgttcaaagagctgagccgctctaccagcatgtctgttgctctatcagcaattttggcagctatctgttcaatgaatttctcatcgtattgcatagtgaacatataaaaaacctcctttacaatgagctttataatctctcactttcatgtggtaaaatatgcatggaaggtggtgagatttaatggcttctactaaggtttacgcttgcctttgtggtgaatgggttgacttgactagtgatccggactgcaaaataggtgaatctatgtcttctccatacatatggtgggaagaaggtgcttcaatttggagccctaattctaaagaagagcacacgatgtatcagcaagattacgttaatatttattacaaaaatgctgaatatcgcattcacccaatgtttatccaaatcaagtattcatcctaaattcacgtttaaggttagcttctaacagttctgggtcgtcaaactgcaatttggcggctttagaactgaacagtacatcgacatgttgtttaacacggctccactcggattgggacataccattcaacaaatttttaatttgttccagctttttttgatccataacttcgacctcctatactgtttttttgtaactttcattcctaagcagttttctcgttaccctttttgtgtaacttttcattaaaaaaaagctcatcgacttcttcattcagtaactcggatatttggtgtgctttttcaagacttggctttgtacgccccatttctatatttgcataaccgcttgcgtatctatagccaagcttttttgccataaaagtttgggtctttccttgagaaagtcttgtagcccgtaatttttctagcactattaactcaccaccttactcttttcgtgtaactcgttaaatacataataatatacacaataagggtaagtcaacatatttttattctttttgtgtaagtaattatctcttgtgtgtaaaccgtgttaaaatttacacaccaaataaaaaaaggtgtataataatggataatataacagggaaaatcttaactgaattaagagaaaagaaaggctggagcaaatctttcgtcgcaaaaaaattaggtattaaaacaatgtctacatatgcgaactgggaatacggtttaaggaaaccagatggagaaatgctcgttagacttgcaagtttgtatggtgtaacaactgattatctcctaactggcaaagaacctacttttaataatgacctttttgatgatcctgatctacagatcgcctttagagaagcgagtgacttctcagaagaaagacaaaaacaagcaattgattttataaagtacctcaaagagaaagaagaacgtgaaggccgtaagcctaaaaagtaactaactgccgaaacctttatttatattattgttattatgttatttctgtttactaataagatcaggattggatcgggattagaaccgaactggatcggaaaagaatttttcaccagtaggttgaagccaattatatcaagggaaatagaattctttctcatctggattgcatctggattcaaacgggatctgatcagaaaaaaatatactcaagtgtattacttataaaggggaaattaaatttgtcttttttgatggaaaatggcgaaatctataactgtcagtttaaaaaacgcatgaaggcttctaaaaatttcttgaaaacttatgaagcagctaaacctctgattgatgaaagaaatgaaacaattcatgaactcgtttgcggaactatgaagagtgacgcgacatgggggcattttattgctacagaaaatcaagtatatttcattgtcttgaaaaagaaaaaaccaattttaaagaattggccctataaagaaataattaaaattactgccagtcgcaagccattaattggacataagattgattttaaaacagccgaagaagacttaaacatcaattcaatatcagaaggtgatattgacggctttatcaaatatgttgaatcaaaaatctctggcaatgaggaaagatacgaaagtgaaaaagaggatttaaagaaagaaactaaagaatactattttaaatcagcaaaaacaacaatcacacttgatggaaactatataagagtagcaagaaaaggcgctgttaacactatcacacgagggtatagtggggagaaatcttatagaatcagtgaactgtccgggcttcaaataaaaaaacctggattagtaacctcaggctattttcaatttttaacgccagctgctaatgaaacaagtggactctgggacgcaatacaagacgataactccttcacttttggcgcaaatgaactgcctatggttttagaaattcaaaaatacatagaagaacatcagtctattccagctccaacaataccaccagctcctgcccctactgtatctgcagctgatgaattgaaaaaatataaagaattgttggatatggatgctatcactcaagaagaatatgaaattaaaaagaaacagctattgaatttatgacagcccttcttcctcgggcttttctttcacaccaaaaacagaacatacattccctacatggtggtgtttttaatgtcaatccagttatcgtatcttgaagaagaagtgaaaaaaatctattacaaattaaatattgagactcctgaagacattgatttagaaaggattgccgcggcatttcgtatctggctgcattatgagcaaagagaaagctgcatgtttcaaattaacggtgagtatagcgttgtccttgatgctcgagcctctccgcaagaacagtggcaagactttgttcatgagctagggcatgtgattaaacattgcggaaaccagttcaacatgaatcgtatgtttcgccagttgcaagagtatcaggctaatagctttatgtatcatttctgtgtacctagttttatgcttgaaaagatttcgttgccacgcatgaaatcagaggttataaaattaataggtgatacctttaatgttacatatcaatttgctgctaaacggctcgatatgtatacaagaaaacagttctcattcttgatgtataaacagctctttaaaactattcattgaaaaattggggtgacaaaatgtatacagaggaattgatcaagggtaaaaaatggctggctgttggtgacggacctcgtgatcccgttaccggtaaacgcaaacaaattgcgcggcgtggcaaaacaaaaaaagaagctgaacaaagagttagagatgctattgatgccttaaaagaagatggcattgatgaatcagttgttaaaaaaatgactttcgaaaagcttgctgccgaatggttgaacgaatatgctctcacaggaaagaaaaaagcaactctgcgtattcgaaggaaagaaattaacatcttaaaccggtatatcgctaaaatcaatatcgctcaggtaacaggaagaaaatatcaaaaaatactcaacgatctcactgatcaagaatatgcccgtaccaccattagtggtgtgcatacgacagccggaatgatttttaaatacgctgtaaaggtgaagcttttaaaagataatccagtggctggcgctgtagttcctaaaaagagaatgacagtagaagatattgaaagtagtaaaatagagcaaaaatatcttgaaagggaagaacttgaagagttcctcttagcagtaaaagtccatggtttggaaatggaccttgaacgattttacttgctcgcttttacaggcatgcgttcaggggaaatgtgcgccctcaaacttcctgatataaattttgaaacaaaagagctgcgtatcactaaaaccatatattccgaagataacaatatgagaaattatgaattaactccgccgaaaacagccggatcggtgcgaactatcactctcgacgatcagataatagatatattgaaggcacatgtaaccaaacaaaagaagttgcgcctacagtccaggattgatccaagcgaataccacgacggtaatttcctatttgctcgtgagaatggctatccctttttaccaaaaaatatcattgtaagaatggaaagaatactggaaaaaacatcaattaaaaaacatgctactccccatatatttagacacacgtatatcagcatgctggccgaggcaaaagttgacttgccaactgtaatggaaagagttgggcatgacgacatgaaaacaacgatgaagatttatactcatgtaaccaaaaaaatgaaagaggatgcctcccacaaagtccagcagacttttggaaacatcctcaatttcgggatttcataaagaaatgttatttttttgttattttttcggttaattggggtgatgaaaaacggtcaaacccttggtgtatcaagggttttttccgtttgattacatcatgccgcccataccgcccatgccgcccatgtcaggcattcctgcgccgccggcgttttcttccggtttgtcagcgacaacggcttcagttgttaagagcattgctgctacagaagctgcgttttgcagggctgaacgtgtaacttttgtcgggtcaacgatacctttttcgatcatgtttacccattcgccggttgcagcgttgaagcctacgccgattttttcatttttcaggcgctcaacgatgacagatccttcaagtcctgcattgtgtgcgatttgacggatcggctcttcaagcgcgcgaagcacgatgttgatacctgtttgcgcatcgccttcagcttccactgcagcgactttgttgtatacattgacaagcgctgtaccaccgccggatacgataccttcttcaacagctgcgcgagttgagttgagggcgtcttcgatgcgaagtttacgctctttcagctcagtttcagtcgcagcgccgactttgatgacagctacgccgccggcaagtttcgcaagacgctcttgtaatttttctctgtcgaattcagaagttgtttcttccacttgagcgcggatttggttgacgcgagctgcgattttttcagtgtcgccggcgccttctacgattgttgtgttttctttcgttactacaactttagaagcgcgtcccaattgtccgatttcagtagatttcaggtcaaggcctaagtcttctgtgattacttctccgcctgtaagaacagagatgtcttcaagcattgctttacggcggtcaccgaagccaggagctttaacggcaacagcgttgaatgtgccgcgaagtttgttgacaacgagtgtagcaagagcttcaccttcaacatcttcagcgatcagaagcaatggtttgccttgctgtacaacttgctcaagcacaggaaggatttcttgaatgtttgtgatttttttgtctgtgattaagatgtaaggattgtcaagaaccgcttccatcttatcagagtcagtcaccatgtaaggagacgcatatccgcggtcgaattgcataccttccacaacttcaagctcagttgtgaagcctttagactcttcgattgtgatgacgccgtcgtttcctacgcgctccattgcttcagcgataaggcttccgacttcctcatcagcagcagagatcgcagcaacctgagcgatagactctttgccttcgatcggcttagaaatttcttttaagttttcgattgccacggttacggcttgttccatacctttacgtacgccgacagggttagctcccgcagttacgtttttcaggccttcgcggatcatagcctgcgcaagtacagtcgcagtcgtcgtaccgtcaccggcaacgtcgtttgttttgctggctacttcagctacaagcttcgcacccatgttttcaaacgcgtcttcaagttcaatttcttttgcgattgtcacaccgtcatttgtaattaacggagaaccgaattttttctccagaaccacgttacgtccttttggccctaaagttacttttacagcgtcagcaagcgcatcgacaccgcgaagcatagcgcggcgtgcttcttcactaaacttaatatcttttgccatgttaacgaaacctcctcgaatttttaaaaatatttatttgcttagccgattacagctaaaatgtcgctttcacgtaagattaagtattcagtaccttcgtatttcacttcagtaccggcgtattttgagaagataatgcggtcgccctcttttacttctaaagcaacgcgctctccgctttccaacacgcgacctgaaccggctgccacgattttgccttcttgcggcttttcttttgcagaatccggtaatacgattccgctggcagttttttcttcagattctacgagttcaatgacaacgcgatcacctaatggctttaacaatgtaataacctcctcaatagtatgaatatgtaattttagcactcagctctaaagagtgctaacacagttattataataaagaatctcacttccaatttcaagtcataagaataaaaaattttcacgcttacatgattctctctcgcactgattttctccttttttcacgtcaagttcacttgtgttacaataagaacaaataagttgattttataggataaaggagtacatatcatttgagaaaacagtattggtatatcattttgacatatgttatcatgcagctttccgcattgatcggcattcctttaatgtacaaattcggctatgcgggcgggcaccctacgaatgcgaatctcaccatggctcaggggatttattccgtcgtaagcttttttatctgcctgattatcgttctcttgattttgagaaccgcgccgaaacagacattaagaaacgggaagaaagcatccgccggcatgtccgttctctgggcggtcgcgggaatatggctcgctttattttctcagggaatcgccgggatgattgagcagtatgtctttcatgtgggcagcggttccgaaaacacgaaagccattcttaacattattaaagccatgccgctcatgattatcgtttcttctatcgtcgggccgattcttgaagaaatcattttccggaagatcatcttcggtgtattatatgaaaaaacgaatttctttatcgccggactgatcagttccgtcattttcggcattgtgcatcaagacctcacgcacctgctgctgtatacggccatgggctttacctttgcgttcttgtatgtgcagacgaaacggattattgtgccgatattcgcccatgtcatgatgaataccattgtcgtggtcatgcagctcggccccgcccaaaaatatattgaacagcatagtgagcaaatgcaattaattattggaggattgtttgtatgaggaacccaatgacttggggcttgatttatttcgcagtcggctgtatctttacgtatttggccgcaagctctccgggaagcatgtggtctttttattccatactgctgatggttttcgccgcttataatatcagcatctcgtttaaaatgttcgccttctcatttaaagtgaagaaaaaccaaaaataataaaagaaaagccatttctcatcattgagaaatggctttttttatgctgatacgtcctggtcagattcactgccggtctgccttttccgatacgccgcttttgaaatcaggatactgatctcgtataaaatgcaaagcggaatggtaatcatcaagtgagacagcagctcaggcggcgcaatcatcgcggcgatcacgagcagcacaaaatatgcgtacttcctgatcttcgataaaaacctcggcgtgataacaccgagtctcgttaaaaacatgatcagcaccggcatctgaaacagcagcccgaacggaatcgtcagctgcagcagaaaatgaaagtactcggtaatcccgattacctggttgacatccaggtcattcgagacccgcttcataaaatcaacgaccagcggaaataaaatataataagaaaacgacacaccgccgacaaacagcacgatcgaaatcggaatatagctgagtgttactttgcgctccttctcatacagacccgggctgacaaacgcccaaatctgatagagaataatcggcgaagtcaaaatgatgccgatgataaacgcgaactgcaaaaagataaacagcggatccgtcaggttaaaagcattaagggtgagctcttttacttcatcggctttttgaagatacacaatgataggttttgccagaaaaaagccggcaataaagaaaaccgtaaaggataacgccacaatcagcaatcgtttccgaagttcggcaatatgctccacaagcgtcatttgattcactctcatacgcgtcatcctatcttactgttcttctttctttttttcctcttcttcaccggctaatcccttagtagcgttcttaaattcacgaagcgtgtcccccgccgcttttcctaattcgggaagcttcttcggaccgaaaataatcaccgccaccacaccgataaccgccaggcttccaggaccgatcatgtgcagctcctcctttcgctattcaatttcttccaaaacagaataatgctttaagaaataaaccaatgattgaagctctactgctaaatctatatgatgaattcgaatgtgatccggcacattcaaacgggccggcgtaaagttaaggattcccttgattccgagtgacacgagccggtcggtgattgactgggcggcaaccgccggaacggtaagaatcgccacgggttcatcctttatgtgaagctctaaatcattaagatcaaagacaggcacaccgcctacctcagttcctattttactctgattcacatcaaaagccatagatatttttgtgttattattttttgtgaaattatagtgaagaaacgccgtccctaaatttccgacaccgatcaaaatgacgttcgtcgtttcatcctgatccagtgtttttctgaaaaatgacagcaggtaatccacattatagccgtatccttttttgccgagcgccccgaaataggaaaaatcccggcggatcgtggccgaatcgacttttaccgcatcgctcagttcagccgatgaaacgcgctgctttcctgacgcgtgtaaattctttaaaaagcgataataaagcggcagccgttttgccgtcgcctgtggaatttttgattgatccttgttcatgattggtcctccactttatactcagatgcatctcttttaaaatcaccgtttttgcctcctgttttttccatgaggcaggtcgggccgatgaccattcctttatccagcgccttgcacatgtcatacacggtcaaagcgcagactgaagcggaagttagcgcttccatttccacacctgtactccctttcgtttttacgcttgcctgtatatgaagaacggcttcggaatccttttcctcccagccgaatgaaatgtcgacgctgcttaaagaaagcgggtggcacatcgggataatcgctgacgtctgctttgcggccataattcctgccacctgtgcgacagccagcacgtctccttttccgatctcgcggtttttgattctgctgtacacgtcatgcttcatgtgtacgctggatatcgcagcggcagtacggactgttgaagatttatcgcttatatccaccatgcgggcacggccttcttcattaaaatgagaaaatccattcatatttaaactctccttacttctgatcatacactattttctccctgatgtcttatcctataatgttccaattctgatgtattgtttgctgacagcaggttgataagctacacttaacttattataacagaggtgaaataatatgatgatcttacaaattaatcagctatccaaatcttttggcgctgatcctattttaaacaatataaagcttgaagtcagatctcgggatcgcatcgccatagtaggcagaaacggagccggcaaatcaactctccttaaaattatcgcaggtcacctttcatatgaaaagggtgaattaatcaaaccgaaagaattaacgatgggatatcttgcccagcacacaggcttggaatcccagcttaccataaaagaagaactgctgagcgtttttgatttcctgaaagcaatggaaaaagagatgcgctctattgaagaaaagatggccacggccgcccccgcggagcttgaaacgctgatgaaaacctatgacaggcttcagcaggatttcaaggataaaggcggctatcaatatgaagcggacgtccgatctatccttcacggactcggcttcggaaaatttgacgattccgtgaaagtgcaaagcctgagcggcggtcagaaaacaaggcttgcgctcggaaaactgctgctgacccagcctgatctgcttattctggatgaaccgacgaaccatctcgacatcgatacgcttacatggcttgagcattatttacagggatattcaggcgcaatcctgatcgtttcccacgacagatactttcttgataaagtcgtcagccaagtgtacgaggtctcacggacagaaagcaaaaaatacctcggcaactacagcgcctatttagaacaaaaagctgagcagtatgagaaagacctgaagctgtatgaaaaacagcaggacgaaatcgccaagcttcaagattttgtcgaccgcaatctggccagagcttctacaacgaaaagagcccaaagcagacgaaaacagcttgaacggatggacgtcatggcaaagccgctcggggatgagaaatccgccgccttccgttttgacattacaaaacagagcggaaacgacgtcctgcgcgtacaggatctttccatcagctatgacggccagccgccgctcttgaaaaacctgaccttcggcattacaagaggcgaaagcgccgccctcgtcggaccgaacggaatcggcaaatcaaccttgctgaaaacgattatgaatacaatcagtccggaatccgggtcgatcacgtacggttccaatgtcacaatcggctattacgatcaggagcaggctgaactgacatcgtccaaacgcgtgctggacgagctgtgggatgaatatccggacatgccggaaaaagaaatcagaacatgcctcggcaactttctgttcagcggagacgatgtcctgaaaccggtccgttcgttaagcggcggggagaaagcaagagtcgcgcttgccaagctgatgcttcaaaaagcaaactttctcatccttgatgagccgacaaaccaccttgacctggacagtaaagaggtgctggaaaacgccctgatcgactacccgggaacactgttatttgtatcgcatgaccgctactttattaacaggatcgccacaagagtgctggagctgtcacctgatcatgcagaagaatatttgggagactatgattattacaccgagaaaaaagcacagcagctggaactggaagaaatgaagcggcaggaaaaggagcagactcagcctgccggcaaggtcaaacaggatacgaaaagaacttacgaggaagaaaaagaatggaagaagaaagaacggcagcgcctgagacgcattgaagaaatcgaagcggccgtctcatccgccgaagagaaaatcagtgccaatgaggagctgctgtgcgatcctgacgtgtatcaggatcatgaaaaagtacagaccattcacgcggagaatgaagcccagaatcaaaagctcgaaaacttattagcagaatgggaggaactctcctcagaagaatagaaaaagtcaagcacctctttaaggggtgcttttttatccacagctatcctccttgtcagccatttaagtaagcgttttatacacactatccacaaaattttctgactttatccactttactaacaactttcagtcccttatccagactggatttctgaatatattcacaatcctgtggatatgttagaattatctgttaataagtaaaaaaaagcctcacgttttacaacgtgagacgatcaaaggatgttaattccaaaccgggctgtccgttcatatcgtacgagccccggatccccttttcaaaagcaacggttccggcagccgcaatcatcgctgcattgtccgtgcataaagaaagcggcgggatgacaagctcgggatctcccgaatggctgaattcctgctgcagtgcggctctcaaccctttgttagcggctacgccccctgcaagcagcacttgtttaaccctgtattctttcgcggccttagaggtttttgccgtcagtacatcaatgacactctgctgaaagcttgcggcaagatcctccggaggaatcacctcatttttttgcgaggcgttatgaagcgtgttaatcacggctgatttcaggccgctgaagctgaaattgtaagacccttcttccagccacgcacgcggaagcggaatggaatccgttcccgcagcagccagcttatcaatctgcggccctcccggataaggaagccccatcgttcttgccactttgtcgtaagcttcgcctgcggcatcatccagcgtttcaccgataacctcgaatgaaccgtgttctttcatataaaccaattccgtatgtccgcctgacacaaccaaagcaagcgccgggaactgaagctctcctatcagcctgtttgcataaatatggcccgcaatgtgatggacgccgactaacggtatttgatgggcaaagcttaacgcctttgccgcattgaccccgattaacagggctccgacaagtccgggtccttccgttacggcaatcgcatcaagatcatcaaagcccatctccgcctttgaaagagcttcctcaatcacaagggtaatctgctccacatgatgtctggacgctatttcaggcacgaccccgccgaaacgtttatggctttcaatttgagaagcgacaacgtttgaaatgatgtcttttccgttttttacgactgaggccgcagtttcatcacagcttgtttcgattcctaatacataaatatcttgtttttcactcatgtaatgtcacccacattaataacgcatcttccccgttatctgtatagtattgttttctgattcctccggcctgaagaccgaatttcttatataaggattgggcgggatgatttgagaccctgacttcgagagagagccttcttgcctttttttctctgcacaattctatcgcagagcgaaacagcgcttctcccaacgattggccccgatattccggcttaatggctatgttcgtaatctgcgcgtcatctataataatccagattccgcaataccccgccagacagccgtccttttcaatgacaaggtagtgggcatacggattttccaaaagctcatgataaaatgaatccttcgtccacggagaagtaaaggatgctgtttcaatttcataaatttgatcaatatcttccggccgcatgcttcgaatcgccgttttcgttttcatccctatcaccctatttttgagattccatccatttcgcttcagcctctgccagacgcaaataatccggaacaaggctgtggacatccgcttcttctttttccaagcctaaaaacgccagctctgacggccgcggattatgctgtgcagccgttcctatcactgcttgatttgtcagcccatgcagaatggtttcttcatgaatggctgtatcatgccctaaaaataaaaccggagacgctttttctttcagcatgtcgagccaatcagtcaaaagcacattctgatcaggaagaacggattgtaagcggccgtcctgatattcataaagtcccgtatatacctgtccgcgccgggcatcaaataacgggcagatcagtccttgaaagtgccgtccgttagccgccagcacctccaggctcgagacagcggaaaccggaagcttcagcgaccatgccaatgtttttgccagcgtcacaccgattctgacacctgtgtacgatccaggtcctttcgccaccgctattttcgtaaggtcctgcggtgttaggccgcaatccttcagcaatgaattgacagcaggcatcgcccgcacggaatgattcttttttaaatatgtaatatactccgccatcaccgttttctctcgaacgagcgcggcacccagcgtgtaatttgacgtatcaattgccagtattgtcatgtttatttatctcctcacaaagcgtttcataccgtgttccgcaagccgtaaaggtaatgtcccttgcctcatcaccggctctcttgatgacgatctgcagccgttcagcaggcagctgatcctgaattaaatgagcccattcaattaaacagacgccttgtccctcaaaatattcttcaagccctaagtcttcgctttcatcctccatacgatacacgtccatatgatatagaggaatcgaaccgtcatggtattcttttataattgtaaaagtcgggctgtttaccactctcgtgattcccagtccttcggcaaaaccctttgtaaaagtcgtttttcccgcgcctaagtcgccttccagtgtcaaaatgtctcccggctttgccaaagaagcggcaagcttggctacggctttcgtttcttcggggtttttcgttctccattgtaatgtcttcaaagtgagtcacccgtcttatttaaaatgattgtatccttttttctcaaggacgatttgtctctgatcattggctgtcaaaagaacacatgcttccttccgttcagataccgcccctatcttcgcaatcggaatgcccgattgagtgcagtaatcaagcagagaggtccactcttgctgagaaaccgttccaaccaattcaaaatcttcaccgccgaataacacccatttcttccactcagaatctgcctcaggcaaatccggatgcaccggcagaagttgttcttcaatttctatcgtaactgaacttgccgcagctatttcatgcagctcactggccaatccgtcactgatatcattcagagccgcgcgctgaagctgagagcagaagcggccgacttgaactctcggaacgggccgtttatgtttttggataaaataatcactcgtatgaaaagcagaaggatgtgtttctcccaacaaaagagacagtcctgctgcggacgagccgatatcccccgtaacaaacacaacatccccgggtcttgccgagcttcgcagacaagcgcaatccttctcaacttctccgatgacagtaacggtaattacggcttgaccggaagcggagacggtatctcccccgatcaaatccatttgatatagtttcgccagttccgccattccttcatacattgcctggacgtcagctttctgccagcaagaaggaaccgctagagacaccaaataaaacttcggaatgcctcccatcgccgccacgtcactaatgttaacagcaagcgccttataaccgatatcatgaggagaggaatactctaatttaaaatggacattctccaccattgtatcaaggcagacaatttgctgcatgtggggtgacgctgtataaaccgcaccatcatcaccgatccctacatcgacggaaggatgataatgcgaatgcggtgtaatactgtgaatcaaatcaaactcatccatatatctcccgtcttcctttctgacgctcttgtgaaatacagctctttctagtgtatcggattatgtttcaatatccaagactttaacgatataaaagaaagcttggttagataccaagctgccagcattaaaagaaaacacaaaaaaaacgaaaacatgatcgtttcgtttacaataaaaatggcggtccggacgggactcgaacccgcgacctcctgcgtgacaggcaggcattctaaccaactgaactaccggaccatttaatttttggttgcgggggcaggatttgaacctgcgaccttcgggttatgagcccgacgagctaccgaactgctccaccccgcgatgataaaattttagaaaagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaatatctcgaagaatcgaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattataatggagcgggtgatgagaatcgaactcacgacatcagcttggaaggctgaggttttaccactaaactacacccgcatttgaattggcgcgcccgagaggagtcgaacccctaaccttttgatccgtagtcaaacgctctatccaattgagctacgggcgcttatcaggcgacttaactatcatactaccaatcagttatgatgtcaagtgttattttatttcttttcgaagtcttttttctcgacctcatttattatacacgctttcgagaatttgtaaagtcttttttaaaaagatcattttctcatttgtcgttatcgctttgttcatcagcgacgtttaataatataccacgcactttaaattaggtcaacacttttacgaaactttttttccgcttattattcccttctatataataaataaaaagcaggattcccaggaaccccgcgtctattcagattacccgctcacctcggcttctgcgctattacgatctgttttttcataggtacggaagttttgttcaagctgttcgagcgaaagacctttcgtttccggaaggaaccttttcacaaatataacggacgctatccctaacaggacaaaaatgaagaaggttgcagacaatccgatgtttgcgagcatgaccggaaaagttaaaccaacaatgaagttcacgatccagaggcagaagacagtcacccccataccaagcccccgcaatcgcagcgggaatatctccgacagcatcagccaggtcaccggagagacagccccctgctgaaacgcaaggaaagtgactgttaatgaaagaaccacataaggaagagcaggcgatcctttcagcacgacagacagaactccgatcaaaagcagcaccgcagtcgttccgatcagccccgtcatcagcatcgggcggcggccgactttgccgagaagccatattcccacaaaagtcgcgagcaccgaaatcacaccgttagcgatattgccgattaatgcggcttttgtctcaaaaccggcatcttttaaaatttgagttccataatacataattgaattcacgccggtgagctgctgcactaccgcaattccgatcccgataaacacaatgcggcgcacccacggaacggcaagatccttaaaggtcgcctgctccatctgagcttccttatgaaaggcagattcaatctcagcgagctcagacttcgctttctcttcattccttattcgccggagaacgtgcaaagcatcttcttttcttcctttagaaaccagccagcgcggactttcaggaactttcagcataccgaaaaacaagaataccgccggaagggccgcgataacgagcatataacgccaagcgtgagaggtatcaccaagcacattgccgatgatagcattacacgtgaaggcaagcagctggcccgttacaatcatcaattcattttgggtaaccattctccctcggctttccgccggcgacatttcagccaaatatgccggaacggttacggatgctcccccgacggcaagccccagcagaaaacgggagatgatcataaccgatacgttaggcgccagtgtacatccaagcgtcgctataaagaacaaaacggcaaggataaggatatttttacgtctgccgttatagtccgacaatctccctccgaaaaccgcgccgatcgcagcgcccaagagcagggagctcgccaccatcccttcagtcaaagcggtaagattaagctggtcagcttccgccataaacggcagcgccccattaatcacaccggtatcgtagccgaaaagaagccccccgaatgtcgatactaaaatgatggttctcaaaaatgaatgctggctgctatttttattcatcttcaaatcctcctagtttttacacagagataatatcggaatattcagttatcaatatttacacctctaacgtctgcatacaaggtctgaccgtccaaaacagttatataagaagaaaatgttccgaaagcgttatcatttatagtgattattcgctctccccctctcgtcatattgttattttatagttactttgtagtgaagttataatgatattattggtacttatgttaatatcataattttaaaagcgctttcagtcaataaatatttcagaaaattttataactcacctttatatcacctatatataatcaattttcgttttatatcaatttatttccataatatactcaattaattacccctattataatcaataattgattacatattgaaaacccccaactgctgattgggggtttttgttttattcttcgtttattgtaacaatcgttctccctctcgcttctccttttaaaagggcaggaagcgtatccggcagctcttcaagtgtaatttccttttgaataaaggcctccagatctgcaggcttgaagtcatcagctaaacgctgccatgttttctttcttgtctccatcggacagaatacggaatcaattcccaagagactgacgccgcgcaatataaacggaaagactgtagccgggagtttcgttcccgctgtcagtccgctcacagcaactgatccgccgtactgaatctgactgagaactgaagcaagcggctcacctccgaccggatcgacggccgctgcccatttttgtttttgcattggttttaacgtgccgttatacacttcgtcgcggtgaatgaccgtctttgctccgaggctcttcaaatacccgctttcttcttcttttcccgtactggcctcgacctcataacctaaggttgaaagaatggagacggcaaagcttccgacgccccctgtcgctcccgtcaccagcacctttcctttttcaggagcggcatggttttcttcaagacgctggacggacaatgcggcagtgaagccggcggttccgatcgtcatggcttctttaagtgtcagaccttcaggcagcggcacgatccaatctgccggaatgcgggccagcccgctatagccgccaaaatgggaaacgcctatgccgtagcttgtcgcaatgactttgtccccttctttaaaacgggcgtcatctgaagaaacgacgattcccgctaaatcaattcccggcacgaaaggatacgaggttacgatcttgccgtcaggaatggcagccaagctgtctttataattcacccctgagtagcaaaccttaatcagcacttcaccctcgggaaggtcctgaaccgccagctcccgtacgctgactgaaaaccggtcttcacgctgatcgactactaacgctttaaattgatctgtcatcactacgtctccttaaaatgaattgaatggctttggaaaagcataaaataagtttgatttgttttcaaatgtcctgccctgtgtagtatgatcaaaagtaaaaacagcgaaagagtggttacgcatcatgtctgataaacaaaacaaagataacaaaaacaacaacagcaatcagccattaccggacattattcataccgccgttttcaaggcgccgatacaagttgtctgggatacggtctctacggcggacggcctgtctctctggtttatgccgaatgatttcacgcctcaagaagacagtgagtttcagctggaatctccgttcggtccgtctccgtgcaagctgctggatattgaagcgccgtaccgcctttctttttcgtgggatacggaaggctggatcgtctcttttgtcttaaaggaaacggaaagcggagatacggaattcactctcattcacggcggatggaaagagccggaagccgtcatcaataaagtcaatcggaaaagctccgagattcacagtacgatggatcaaggatggaacgggcttgtcaacacgaaacttcgcggggcggttgaggcttaacacaaaaggacggacacgctttccgtcctttttttgatgccgatacataaaaactgactttgcaaagacactaacagaagaaccgaaaacttctttcagggggcgctgtttatgtattattacaaagaagagctgatcaatatcattaaaccggacaagccggacccggccgcggccaaggtgcttcaggaaattttaggcgggcattacggggaaatgcggacgatgatgcaatactttttccaaagctctaatttcagaggaaaagaaaagcagttccgcgacctgcttcgcggcgtatttttagaagaaattgcacacgttgagctcgtccagcatacgattaatgcgctgctggatgaaagcggcgctgagggcgccggaaatcaggcagcagatcaggcgccgctagacgaagcggttaaacacgccaatccgcaccattatattatcggggcgcaaagttctcttcctgccgatgcaagcggcaatccatggaacgggtcttgggtatacaaccacgggaatctgatttccgatctattggacaatgtcgtgctggaatcaaccggcgtgctgcaaaagacgcgcatttatgaaatgagctcaaaccagacgttcagagaaacactcggttttctgatcgtccgtgacaacgcccatcaaaatgcatttacaaaagcgctggaaacactgggtgtcgaatggggcaaattatttcccgtgccgaattatgatattgaaaaatacccggaatgccggaaattcgttgaaatgggttatcataatacccaatttaatttcagactggatccgacacggatcggagaaattctgcagggaacgacgccgagccgaaacggcggcgaattaagtgtgtcagagcctcctaaaggtttccccgtgccggaacttcccgagcttccgaatgagcacagccccggactgaaagatatgaacttgtaacaaaaaacgcctgtttcgggcgttttttgtttttctgaatatgaggtttgaatgtgttcaaaacggggaatataagccgggagatcttgccatacggccgtgattttgatgtgagcacatttctgtacatacttcgtttcgaaagttgtcctaattttccagccggccggctgggtatgtttgaatgataatgggaattatgtaaagagaacaatgtcttttttaaggaggcagcgaatgtctaagcaaggaaacttccagaaaactatgtcactttttgatcttattttaatcggcatgggagccatattcggttcggcatggctgtttgccgtcagtaacgtcgcctctaaagcgggcccgtcaggcgttttttcctggctgatcggcgggggaatcatcttattgatcggcttggtttatgcggaactgggcgccgcgctgccgcggaccgggggaattatccggtatcccgtatattcacacggacacctggtcggatatttaatttcctttgtcaccattgtggcatacacgagtcttatttctatagaagtaacggcggtccgccaatacgtggcgtattggtttcccggtttgaccgtaaaaggctctgattctccgacaattgccggatggatattgcaatttgcgctgctctgcctgttcttcctcctcaattactggagtgtcaaaacctttgcgaaagcaaacttcattatttcgatttttaaatatgtcgtaccgattacggtaattgttgtactgatttttcattttcacccgggcaatatgaccgttcacggattcgcgccttttggtttcaccggaattcaggccgcgatttccacaggcggcgtcatgtttgcataccttgggctgcatccgattgtggctgtcgcgagtgaagtgcagaatccgaagcggaacattccgattgcattgattgtttgtattatcgtttctactattatttataccgtgctgcagctcacttttatcggggcgatcccgggggataccctgaagcacggatggccggctatcgggactgaattctcccttccgttcaaagatatcgccgtcttgctcggtttggggtggctggcgacattggtcattttagatgcgattttatcaccgggcggtaacggaaatatctttatgaatacgacttcacgtctcgtctatgcctgggccagaaacggaacattattcagcattttttctaaagtcaataaagaaaccgggacaccgcgtgcctccctttggctttcgttcggtctggctgttttttggacgcttccgttcccttcttggaacgctcttgttaacgtatgctccgtcgcattgattctgtcttatgcgattgcgccgatttcttctgcggcgctgagagtcaacgcaaagaacattaacagaccgttttatttaaaagggatgagcatcatcgggccgctgtcgtttatttttacctcttatattgtatattggtccggatggcgcaccgtatcctggcttctcggttctcaaattgtcatgtttctgatctatctctgtttcagtaaatatgctcccaaagatgatgtcagcatacgccagcagctgaaatcagcatggtggatcgtcggcttttatgtcatgatgctgattttctcctatctcggctcgttcggccacggattgggcattatcagcaatccgcttgacctgattctgatcgccatcggttcgctcggtatttattactgggcaaaatatacaggtctgccgaaggctatgatcgacagtgataaatgacgaatgccggaaagaagtatggtcttctttccggtatttttatgttaagggatgacaaaaaagcgaacatgcgataaaatgaatgacagtcattcataaaaggaggaacccctctattggcaaaacaaagctcgggaaaatacgaaaagatcctgcaagccgcgattgaagtcatttctgaaaaaggattagacaaagcatccatttcagaaatcgtcaaaaaagccggaacggcccaaggtacgttttacttatatttttcttctaaaaacgcactgatatccgcgattgcagaaaacctgctcgacactacgctggacagaataaaagggaaaacggacggttctgaagatttttggacgttgctggacattttggtagatgagacatttcacatcacccggcttcataaagatattatcgttctctgttattccggtcttgccatcgatcattcaatggagaaatgggaagccatttatcagccttattattcctggctggaaggcatgatcaatacggccattgaacagggtgaggtcatcagcggcattcatgtcagatggacggccagaacgattatcaacgttgtcgagaacgcggctgaacggttttatatcggctgtgaacaggatgtcgatctcgaagtatataaaaaagaaatattcagctttctcaaaagaagcttgcagaaatgattggcggagaccgatcatttttgaccgccgtaaaaatgactgacattcattcataactgaggtgactgtatcatgtattggctgcttgtattgatagccggattgttagaagtagtttgggcgtccgccctgaagcatgcggattcgctctttgattggattggtattttccttttgattgccgtcagctttctgatgctgatccgctcttataaaaaaattccgatggctgccgcatataccgtttttgtcggaataggcaccgtcggcacatatgtaacgggcgtcattttaggcgaatcgttttcaatcggacaaatattctttttggctttgctgttgtccggcattttaggaatgaaggtatttacgaaagaaactgaaacaaggggtgaacattaatggcatggctgctgttatttattgccggagcggaggaagttgtagcggccgttgccatgaaacatattgacggttttaaaaaaaagtggccgctgattgtcatggtaacaggctttatgctttcattcttttgcctttccggagcgatgcaggttcttcccacaggtgtcgcgtatgcggcttggaccggcatgggaagcatcggcgtttcggccgtaggcatactttggtttaaagaaaaattcaatctgtcacaattggtgtctctggggcttatcctcatcggtgtcatcggcttaaaactgacagcgtaacggcctgagacagctttttaaataaaaaacaaaggaccctaaacgggtcctttgtttttttatgctgttttgatctgttccgcttttcccgctccgactccgaaaatgaaaatcagaacagagactgcgatcagcatgaataacggaaccgtccagccgtgcgtgatgtcatgcagcaaaccgaatacaagcggcccgaacgcggcaagcaggtatccgaatgactgggccatgccggaaagcgccgcggcttcatgaacatgccgggtccgcaggctgaagaacatcatcgccagactgaacgcacagcctcccgcaattccgatcaaaatgacccatagcggagtgagagccgggcttccgaaaagaacgccggcaatgccgataaggaaaaataaagccgtcagtccggcgagtgcgcgctgatttttcattttagcggcagcgatcggcacgataaaagtaatcggcaggactgagaattgcattaatgaaagcatccatcccgccttacttgagctgagtccattctgctgaagaatttccggcagccaagcgatgacggtgtaaaaaataagggattgcagccccatgaacatcgttaccttccaagccagcggagaccgcatcagactgttttttttctctccgtttgtcccagtcgtgcggacgggcagttcgcgtcctcgcatttgcggaatccacatgacgaacgcaataaaagaaaggatagcccagcagccgagcgcgcctttccagcctacccccgctgaagaggcgatcggcacgctgatgccggatgcaatcgcgccgcacagattcatagaaaccgagtagacgccggtcatgatgcctaaatttccgggaaacttatgtttaatgagactcggcagcaggacgttgcatacggcgatcgacaatcccaacaggatcgttccgaaaaagagagtgccgattccggcgatggagcgcagcagagttccggctgtcaggacaattaatgatgacagtaagacaatctcggtcccgaagcgccgggacaataaaggaacaaacggcgacagacatgcaaaggccaaaagcggcactgtcgtaatggtgccggcagccgcattggtcatgccgaggctgtcccgaattgaggaaacgagcggtccgaccgatgtcagaggcgctctgaggttggcccctatcaatatgactccgatgaccagcaatatcagttttttacgctgacttgcttgcagaacttgatgttcgtctttaattttcatgttcatcctccatgtgtattgtatctttaaatactgtgatgtattggttgacggcctccatggcctgatccggtttctgtccgataatcgcggcggcaagctgggtgtggatccggatagcaggggtgatttccaacaggttatggactgacgcacaaagcgcctccgtcatatgctcgtatagatcagaaagcatattgttatgggccgcctgtacaattgttttgtgcagcttaatgtcggcttcggcataccgttttcgatcttcattttgcaaggccgcttcacattcatccaagcatgccttcagtgctttcaggtcttcgtcattacgcctttccgccgccaatcgtgcagcttctctttcgagtgcgtatctgacttctaatgtttcaagcaaatttgattttttaatatggcggtaaaatgccgcgccgagaacactggatgagctgacatacgtaccgctcccctgccttgtctgcagcaggccggcatgtacgagcgcccgaatggcctcacgcaacgtgtttcggctcacatcaaattgcttcattaaatccagctcagggggaatgcgcgtcccgaccggccatttatccgattgaattaacgattcaatttgcgccaccacttgttctacgagcgacagtctgcttgttttggatatctccatcaaaacacctctgaaatttgtaggatgattctatcattgggtaatataacataaaagaagcgacgatgtaaatcagcggcaacaaaaaaagagtgagtttttctctcactcttcggcgcttttatgaacgttttatattgactgaggtcacgacaaacttgtcatgacggtggcgggaaaatgaatattcaaagggagtgccgttgtccaaaaagcctacatgctcgacttcaagtatcgggtcatccggccggcagccgagatattgctgatccatatcatccgacttgcacgctctgatttttctgtgtgtgcccgcgattttgagctgcaatccccgcgtaatatgatcgtagatggaatggttgagcacctcgtcattaatgccgggtataaggctcgccggcatgtacgttttttcaagaacgtacggttcgccttcaacgattctgagcctcactacataatagacgggagtcttttcatcgatagccaaatgtgcggcgacatcttgagacggaaactgcacttcaaaccggatgaccttgctcttgatatttttgccttttaacaaattgctcaagccgagaatttcgttgctgactacgtgaacgtgctcatcctgcatggctgattgaatgataaatgtgccgtgccctctttttctgaaaagcatcccttcagccgcaagtgtatcaagcgcccgcttcatcgtcatccggctgcacccgaactccgcagcgagcgtcttttcatccgggatcggctgatctatgtcatatacactgcttttaatcctctttctcatttcgttggcgattttttcgtacttattcatcggtttcctccggctgtgtaatgtttgatctgtatagactccttacggttatcataaatttttttccctgcttcatcaatgacgttacagccgccgatattgaaattgaaaggatttcctcgaattttctatggaatctccctcactattatggtagaattttttgcagaaacggacacaaccgaatattgcaatatattgtataacctcaatgatatggtttgagggtgtctaccaggaaccgtaaaatcctgattacaaaaattgtcccgtacactttttgtaatcaggattttttattttctaaaaaataaaaaaaggagtatctgtacatgaatttcaaagtatttctgcttgcagcatctaccatcgcagtcggattggttgaattaattgtgggcggtattcttccgcaaatcgcttccgacttagatatatccattgtcagcgcggggcagctgatcagcgtgtttgcgctcggttacgcggtatccggcccgctgcttttggcagtgacggcaaaggctgaacgaaagcggctttatttaatcgcactgtttattttcttcctaagtaatctggtcgcttatttcagtcccaatttcgccgttcttatggtgtcacgggtgctcgcttccatgagcacagggctgattgtcgtcctttctttaacgattgctcctaaaatcgtggcgcctgaatacagagcgcgggcgatcggcatcattttcatggggttcagctccgcaatcgctttaggcgtgcctgtcggcattatcatcagcaatgccttcggatggcgtgttctgttcttgggaatcggcgtattatctctcatttccatgctgattatcagcgtctttttcgaaaaaatacctgctgaaaaaatgattccgtttcgtgagcagatcaagacgatcgggaccgccaaaattgccagcgcacaccttgtcaccttgtttacattggcggggcattacacactctatgcctactttgcgccttttttggaaagaacgcttcatttgagttccgtttgggtcagtgtatgctactttttgttcggtctgtcagcggtatgcggcggcccgttcggaggctggctgtatgaccgtttaggagcatttaaaagcatcatgcttgtgaccgtttctttcgctctgatcctgtttattcttccgctgacaacggtttctttaatcattttcctgcctgcgatggtgatctggggattgctcagctggagccttgcgccggcgcagcaaagctatttaatcaaaattgcgcctgagtcttccgatattcagcaaagcttcaacacgtccgctttgcagatcggcatcgcgctcgggtcagccatcggcggcggcgtgatcggacaaaccggttctgtcacagcaacagcctggtgcggcggtttgattgtcattatcgctgtcgcgttagctgtattctctttaacgagacctgccttgaaaagaaaatccgcataaatgtgagaccgcaaaaaagccaaaggagttccttcggctttggcggtctttttattttgcggcagcaagctcgtcttctgtcacccatttatgattggttactttttggccgccgtcagtcggtgtatagtcgaccatataaacggttgtctttttggctgaatcaataacggcttcggcacccttcatgcctttcatatgggatgcctcgatcacggccttgtcacccggttttaacgttttatcaccggcgcccttcagctcttcctgaatgacccatttgtgatcttcgacgcgctttcctcccgtttccggagtgtaagatacactgtaaaccgttgtatcataagcaccttttacggttccttgcgcatttttcatgcctttcatatgagaagctaaaatcatgacgtcactgccgactttataagtcggattttcggctttctttaaacctttcggcacctcggatgaacctgagtgattcatgtcttcgtgagagtgcgtttctttgtctttcgctttttcgcttcctcctgaagattgaccgttgcatccggcaagcgccagaacggggatcaggagaaacatgctgaataaaaatagtctcgctttcatttcaagaactcctttgcctttttgatttttcattttccctttcgtttcttcggtaaaacaaaaagatggcctgtcatttctcctaattcttcaactctctctttattgccttttatcaggtgaaattgttcacaaaatgtacacattaatagagatgcagtataatttaattatcagataatagggggaactcatcatgaaaacgaaggtttttgcggtggtattgggcgctgttttaatgattgcggggttggttttggcagaagtttcgctttatatggaatacatcacaatggtcggagctatgattttttcttctatatttatgtcagagccgaaaagaaaatttcgcgtcattaaaggggtttgacttttctattaccgccgtcttctcaggacggcggttttgttttgcatgtcagtcagtctatccgcaaagccgtttcttctgtgccgtcctgatataaaacgaaatgcggggcagtttgtgctttatcacctgcaaattcaatttcaagcggcagcgccctgacaaaataacgggtttccgtcattgggaataattcaaatggtgtctgcccgtctattgcaagatacaatcggttttcttttaccgtcaccgatgcatgtgtgtcatcctgaaatgagtaattgccggtaaatctgctgtaaatcgcaggatcgatatctgcttttttctgatccgccggacgtttcggaatcacgtacggctgatcaaataagatgtttacggccgcggcaatcacagcttgttcaaattgatacgattgttccatattgctgagataaatcagtgttttgttctggtcaatataccggatcatcagagttgaataacccggccagcctccgtcgtgactgataaccttccctttttgggcgctgttttgaatcatccagccaaatccgtatccgaattgctcttcttcattccaatagcccggtgtaaacgcttgatctttagactctttgccgatgatttcttccttataaagagcctgatcaaacagatataaatctctaatagtggagttaacggttccgtcaccttgaatcccgtcaagaaagacgacataatcggtttcctcaagttcatccggcagcacatattctccggaatgaacatcatacacatagccatatgcatagtttggaatgttttctttactcagccttctgttataaatccgcgtatcgtgcatacgaagcggatgaaatacggcttgtttcataaattcagcaaaactcatgcctgatacaatttctataataaccgctaacaccgcataccccgtattactgtatagccactccttgcccggcgggaaataagcatccggtttatgctgcttaagcatatcgatcacatcttgattaacggcaattctgtcccggtcccaatgtgttaaaaataactccatatagtccggcaatcctgacgtatgatggagtaaatgccgaatggtaatgcccggataaggaaaatcaggaagccaccgctctatcatatcgtcataacgcagcttccctcgctgctctaaaatgataacgcctaaagctgtaaacggcttcgatactgaggccaattcaaagactgattggtcattcagcatcctctttgttttcagttctgcagcgccgaatgaaccctgatataagatgcggccgttttccgctgccaatacagctccgtttatttcatgtctttcgtctaaagtgctgaaaagctgttcaaaagcttgttttttcttatcgttcatttcacgaacctccatatacaagctgatttactcttttatacgaacagccgctttagaagtttcaatattttcccttcccggaacaccagtcagtaaactgccgttcaggcagccgcggaggtttaatgaaggtcttttattcgcacaacactgtgcaggcttcgaactcaacatgcttctcgtctttttttgcgccggcaatttccatagtcgaaaacatcgcacagatgacggctttgtattcgttcatgacggtttgaatttcaatcagaaaccgttcggatgaagaggcgtattccgttacgtattctttcattttgccgataatatcatctgcctgacggatgaagccggccgcctccaagtcactctcaaactggtttttgttgatcatatgaatatgcatttttcaaggcccctttcagcagcgttttatggttatatccactgtaaaggacaggcttggataaacttttaataaaatatgaacaaaatatgaattggctcatcggcctgaccggcgggctttcggctgtgctccgtttcatttggactacctgaaataatgacttctttactctatgaaaaacagctcatatatgatctaataccagtaaaatgaacgttaggaggcggcctatgtcagcagcaggaaatcggcaaaaattttgggtcatggcgatgcttatagcggtctttgccgtgtttgttttctctttttccgagaatcattcacaaaagaactggcacacggcggttgaccaggcgtcagtgaatgtcttcggccagcagatctttgaaaaagaccgtctggcaaaaacactcaacgcacgtgaggcagaatctcttctgactcttgtgaaacttgcaaatgaagaacatcacatcatctaaaagccattataaaaagcctgtttccctttggcagaggaaacaggctttttccatgtattattgagcatgtttttgttcaataaaccggtcgatccgggccagaacatcctgcatgtccatacattctttaaagctttcattaatggcttgaatgccttgtttgtattttccgttatgcagcacttcttccgcggcaagctttaccttttcagcgctcacttcatctttttgcactgtacagcctgcatccaattcagtcaggcggcgcgcaaccatcggctggtctttatcatgcggaataacgaccagcggcacttgataatgaatgccttcatttacactgttcattccgccatgcgtgacaaacacgtcggcctgctccagcacttcaagctgcggcacgtacggggcgatgataaagttttccggcgcctgtttgattttcgacagatcggctttttccccggcggcaatgactacttttccttcaaaatctgagaacgcgtctatgcacagattgaaaaacgcttccgtgtccccgagcaccgttcccattgagatataaatgactttttcattctttaatgagtcaatcgggaagtcgacgcgcccttttctcttcggaaaactcggaccgataaataaatactcatctccgaatgtctcactttcgggctgaaaatatctgcttgtatagacgacgttcaattcacctgtgttgttcataaattgaaccatgctgtcaggggcgacaccgtatttgtctttcatctcggccaacagctcttcacattccctgtccggctgaaacggcacgcccgattccggatggagcggcagtattttcagacggtcttcattgaacaggaaggatgctgaagaagagatgccgggaatgttgagataatcccgcaccaactctcccgcaccaaatttatcataatagacggcgtcgaattgaatgtcctctgccagccgctgcacaatatgtaaaatctccagtgacgttttgatatgaacctttaaaaatgcaagtatgccggacggactgccgggatcaatgggtgtcattctgagcagatcgctgtgaagatgaactttcgctcctactccttccagtctgcttttgtatttttccgttgagatataatgaacgtgatcgccccgttcgctgaaggcctttgtcatacccaaagtcgggtttacgtgtccttctgcgggaaaattgatcatcagaatatgtttcgccatttttcaaactcctttgccttttttgcgtctcttccatatccatcataaatgacgcggaaaaaatcatgcaaggaacattcgtcaggtctttatgacggttcgatgacatcggcaaaaaaagacaaggcttttcaccttgtctatcgtgatgattcgtctgtttcacccgctttgagcacacctttcagatgttcttcatcatgcttgagatgctccgtcatatattgcacggcttttgttttatcgcccttttttatttcttcaaagactttccggtgctcatgcaggataacctccgcacggtcatctcctttaaaattaagaactctgcaaaaatgaatcagcacattgacatgctcaagcagcatggccagccggctgttgcggctgaaatccacaaggagccgatgaaacgactcgtttaaggaaataatctcagtctctttgacgcctttattgatggcttcttccgtctcccgcagctgtttttcaatgaggtcaatttcactctcagccgcttcatcaataaccagttcgaccgccaatgattcaagtgacattctgatttgataaatctcttcaacatccttaacggacaaagaataaatgacaaagccgtttcgatcgtctgccgtcagaagcccgtccttttcaaggagccgcatggcttctctgaccggcgaccggctgactccgaaatccttcgccagctgagtctcattcagccgttcacccggtttaaaaatcccgtcaaatatcatttttttcaattgggaataaaactgcagataatacgggattggcttatctaatttaaaattatccatctttcctacctcttcatacaatttaggccttattgttaccaagatcatataacagtttatctatggaagcaacattccagagcttgtcagcataacggaggtgccgtaatatggaagtatagttggtcgagggtattccgtaaaccgaaaacaattcattcggaggtgacggaaacatgaagacatactagattgccggcataccgggggacggtgtggggaaagaagtcgttccgcaagcggagcgggtgttgaacgcgatcgccgaattacatggaggcattgcctttgatttcacttcttttccgcggagctgcgagtattatttggagcacgggactatgatgccggatgatggattagaaacgttacagcactttgatgctttgtttttgggagcggtggggaatcaaaaactcgtccccgatcatgtttcgctgtgggggctgcccatcaagatacgccggtaactacatctccgattttgatctgtaaacgtccgggaaggtgagtacagctctgtcggcagcagcatctatcagggtgaagatgaaatcgccattcaatacgcggtcctttcccggcggggtacggaatgagtgatctgttttcgaaccggcagcgttcggctggggttttgacaaagaaatgatacaattttttacagagatagagagagaaaattgtatgtcaaatcgcagcaggggaactgcaaggaaacggtaacccctcctttaattgtggtgaaaaaagaggatacacctacaagacaggtcgattaagatggtctattggcatcttacatccgcaaatatgtctttacacaaaaaagttagagaggtaaaaaatatgaaaaaaatattttacttttttttgatattatatataattatagtattattacttaattctgtatttgacttaagtaatgtattattaactgttttgtttgctatattcgttggtgcattagtgatttatagcattgcgaaacggagtaaaggtgatgagagaaaaaagtgttaaagaaggttactaaattatttatagcggggtgtattctcgctactgtgttgtctgctttcgctccaagttctgaagcagcttgtcgacggacaaatcttgggactcagtgtgataatgatgttcttcttaaaaaaagggtaaaggtttattacacaaaaaatcaggtgaaaaaagtggtttctagatataacagcatggggtctaataaagggcttattctcggttatattattgggttggtacacccttctactggtttaagtgttttaatgtatcaagtaggagctaataatatgattaagccttttaaaactgctaattctaagaaaaagggtttagagatttcttacacggttaccgtttataagtggtcaaatgcatctactaaggtatctggagtaaaatataaatatagataagactaagtaatacataatgagcaggcgatggcctgcttttttttattacaggagaaatgtgcaaaatgaaaaaggaaaactgaagtggaaatcgatctgcatgtcagggagcctgtgtgatgatgcgttcccagagtgagtcaacagtatgcggattgcagggaggattaaggagttgactcactcagtcagcattcaaacaaacttgtttcaatcggcggaaacacgtcacaagcgcgacgaaatcaaacggtattgttcactcgatgccgttctgggatgacatctttaaagaggtcagccgggagtacgccgggatcgagacggattcccagcacatcgatgcactggcggccttctttgtcacgcagcccgaacgctttgatgtcattgtcgcttcgaatctgttcggagatgtgctgacagatatcggcgcggcgattatgggaagcgtcggaatcgctcccgcagccaacatcaatgtaaacggcaaatatccttccatgtttgagcctgttcacggctccgccccggatattgtcggaaaaggaatagccaatcctatcggccaaatatggacggcgaaattaatgctcgattcattcggagaagaggaactgggccatctcctcttacaatctattgaaacggtcacaaacagcggtattctgactcctgatgccggcggaaaacattcaacggaagatgtcacttccgctattatttctcaaatcaagaacagataatacgaaaaaaccgcgggcaggaaaactgcacagcggttttttcgtctcagacgggacggagcgcgcagaaacaggccgattcacctgtgaagcccgcaatacggcctgattgatccttttctacagaaaaaaaccgctgtatatcacaaggagcatccagcatctgtttttccagtaatgcggctttctcttcagtcaggcttgcccgttcacaccagacggtaaattgaaatggtttcaaaaagcagacagcggattcaatccggaagccggctgtctccagaaaacgaagccattctgtttttttccacgcccgaaagtggctctgatcccgtttcttttcaatgtcattataaaaatggtcatattcatccttttcaggtgcggtattgtcaatgagaagcagtctgccgcccggtttgacaacccgaaacgcttcatgaacaaaggctctgacatcgggaaaatgatgcgccgcgattctgcatgtgacgatatcgaaagcagcatcggaaaacggcatcttttcagcatcgcctttttcgaatgacacgttcgtccatccgtttccggttataaatgcttcagcggctgctaacatttcttccgtgaggtcatatgcgataacagagcgtacgagaggagcgagagcgttagccgtatgtccgcctcccgtcgcgatatccagcacgtccatatgcttttcggcaccggaagctgaaatgagatatgccaaatcctctcctgcggcgtatccgggactagtcacatatttcgcggcgtttttagcaaattgccgctgcgcctgctgtttaattgaatcctccattatacttgggcccccttttctttctgcttgctgccttaatcaaaataaacgggttcgtccggatgtttgagatatgcaaacatcttttcaatctgactttccgtattgcgggcttcagatagcggcggcagttccgtttccgcaaaaaagccggccgcgcttgtttccgttccctccctgagccggccgccgatgatctcgcatcggataaacactttgtaaacgtgggcggcggacggcgggtgggaatggcatttcttatccattacagctaacagtttaacgggctttacgtcgattcccgactcctcttttacttctttgacagcggtctcgcccggtgaaatcccgatatcagcccatccgcccggcagcgcccatctgccgtcgcttttctctcttaccattaatatgctctgatctttaaaaactgccgctctgatatcaactttcggagtgggatagcccgtgtcaccggcgaatacgtctttgatgatgcttttgtcgatgccggtatgttgcgccatgatatccacgcttatttttcttatttcttcaaatctctcaatatcatatatgtctttggaataagccagccccgcttgcgccgcggattgaagctgttttgcccattcaagccattttggctccattttttccaccgcccgttatgttaattaaacgaaacccgaattgcaccttgagagtaccccgtttctgctccttgttttctgtttatggcggagcgaatcctgccgggaaatcagaaaaagccattcatttgctgaatggctttttttcattttctatttttctttcatgacgagaacgacgcctgaaacaataagggccgccccgatccagaaggttcctccgatcgtctctcccagcagcagccagccgagcaatgtcccggaaagcggctgaaagaagaaaaacagaccgccgcttgccgcattcagcaattgtaatccgcgattccaaagcatgaacgcgcaggcggttgagatcacacccagatataaaagtccgccccatatctcaggccgggcaagctgagacaaaggaatctcccgaagcgggccctctgtaaacggggtcaggatgacaaatgcgacgcaaatggaatacgttgtgacgacaagcggtgagtaatggccgggaacccgtttcatcagcacggacatcaaagcccatgtcagcgccccagccagaagcgagagaccgccgaactggctcgacatattgagatctccgttccccacaatgagcaatactccgatcgtcgccagccctgtcgatattccttttttcagcgttaaccgttctttcaaaatcagccgggcaaatacaaccataaatgcgggagtggatgccgtaataatcgcacccatctgcgcggttgataatttcgtgccgatttcctgcgtgacgatcgaaatcgtgttgccgatcaatccgatcgcagcgatcagtaataaatcacgtttatgaactttccaggattggcgtgtaaataaactgagaatcaaaagcgaaaaaagcgccaccgcatatctcagccataccagttcaagcggcggaatgaccgctaccactactttaacgacgacatacataccgccccagatactggcggccaatgccaaataaatcgaaccgaacaatgtatttttcaatttgatgcaccctccgttatcatattaggtcacgtcatatgccttaacggagagaagcgcagtcactttcctccattaagggcggagaagtgctgccggtacatcatgttcaaataagggcgctagaaacatatcgtttttcacctcaattgcaatctgatttttctcattatacaaggtttgtcagaagacgtaaacgaacggcggcatcggctttatcgattgcggacttgcagctggattcttgtgatctgattgtcaaacccgtccgccacaacctcatcaagcaaatattcttcatatgcataatcgcccatttccagcccatactcttcaataaactgcatgatgctgcggtaagccgcttccgcttcatcccctatttggtacccgacggcataaagccctttcggcttgatatggaggtcattattctctatgccttcttctgtcttcatataaaaatgggtgtagttgtagaattcttttttcagaatctgctcccgcgcaaacagtccgccgaccggatgcccctgatcgagttcatgtacccgcatatagcggatcaattcggaaatggccgcagtgtattgccgttctggcaaatggagtacgggtcgtcctatcataagtgtctcttcatctaatcgctgcaatgagacggaggagaagtctgtctccaaagcttgttcggtcagcttcacctttgtctgaatcattctttgcaggtgctccagctttttgattttgctttcgatttctgatgatttctcttttaaaagcgtgatgataccctcaggggttttgtctgttaagagcggtttgatctgcttcaagggcacgccgacctccttaaacagaccgataacctggaacagttcgaattgatgataggaatagtatctgtatccgttcgcttttttgatttccggagaaagcaggccgatttcgtcataatggaacagggtttgtttttttacgtggcacagttttgcaaattcacccgttgtgaagtattttctgacgtcttcgctcataatgcctccttgactatacggtaaccatatcctttatgatgatcattgtatccgagagaaggctgattcacaaatggcttacgcaatgaaagctttaccgtctcagaaaaagcagaagaggagtatcaagtatgacgattgaaatcagagcagtcacggaagaaaaccgtgctgatatactggcgcttcatgtaagggaaagccagacttcatttattgaaaccgcggaagagtgcttacaagatgctgaggattgccggcattatcagccggccggtctttatgttaacggggaattagtcggctttgccatgtacggatggtttccggaatatgatgaggaaaatgaaaacggcagagtgtggcttgaccgtttttttattgatgaacgttatcagggacgtggattgggcaggctgttgcttgatgcccttatccgccatctcgttcgaatatatgagtgcagacggatttatttaagtctgtttgaagataacgtgcacgcattgcggctttatcaaaaattcggcttcttattcaatggagagctggactcaaacggggaaaaagtgatggtgaaagagctgtaaaccctctgtataaaagcgattcggcttcttgccaatccctcaaatttgaggtaacataaagataatggacgacggtcgacggacgacgatcgattgttaaaaacctgataaagcggatctgaacatggtgatcaggcatctaaatggaggagaagattgtgcttattatactcgttatgttccttctcgggattattctagggtttatcggcgcggggggagccggttttgtcattgcacttttaactatactgtttcacgtaccgattcatacggctttgggcacctccctcgccggaatggctttcacaagtttatcgggggctttcagccactaccgtgaaggcaatattcagatgaaaatcggcctcatcgtcggcgtttttgcggcattcggttcgtttttcggggcaaggcttacttcccttatccctgcagatttgctgcattacttgacggcgggcatgctgtttttatccgctctgcttattttagtccggttatttattgtaaaagaaacacatgaagattccggacggcaaagcaatctgaacatatgggtgaaagccgttgtactcggtatcatcgcaggaatcttgtccggaacgttcgggatcggctctgcccctttcatccagatcggcttaatgattcttttgcgcttatccatccgccagtcggtcggcaccaccatgcttgtcattatcccgcttgcggtcggcggaggactcggttatgtgacggaaggatttgtcgattatatactgttggtcaaagtgctgatcggcacgatgtgcggcgcatatgtcggagcgaaattcaccaaccacgtgccgaaagtcattctgaaatcagccatctttttaacaccggccatcgccggtctcatgcttttattttaaactgaaacgggaggcggccgcctcccgttttttctgttcttcacctgttttcgaagagctttttcagctttgcttccgtttcggtatgatctaccggcgtatacacactgcagcgcagatcactgttgccctgaacctgaaatgaagtcaggttaaagaccatttttcccgccttcgcgtggcggaactcaattaatacttcgggtgccgagctgacttcgctctcattccacagcgtatgaaattccgaatacgttttctccatttcttctataaactgagaataccacgtatcagctacatactggccgtagtacgttctgaaaatggcgatgaatcctttcacaaagtgctcccagttcacagctaaacttcttaattcttttctggaaaacaatagctctatgagattccgtttttcaggaggaatttgttcaaaatctaaaaacacgtgagccgcggcctgattccatcccacgatatgacagcgcctgtccgagataatggtgggacaataacggagctcctgcaggatttttgaaagcgacgggctgataaccgcttcttcctccgcggcaaacggctgcttcacgccctcctcaatggcaagcgcgtataaataatttctctcatctttgttgagctgcagcgcatcggaaaccgcgtccaatacggctgcggacactttaatgtctctgccctgctccagccacgtataccacgtggtgcttacgcctgctaattgcgcgacctcttctcttcggagcccgggcgttcttctccgtgtgcccatcggcagcccggccatctgcggagaaattttggcccgctgcgtttttaaaaactctgagagcgcctgcaatcttccttctggtatcataccgaatctctcctctcttaccctggtattcattatactaggataatcaacaacttgtaataggataattgcgagttacaataaatacataccgaaggaggaatgaccatgaaaagagttgtgatcaccggaatgggagtgatttcacctctcggcaatgatgtgcatacattttggaaacacctgacggaaggaacatcgggaatttctctcatcgattcgtttgatgtctccggctccaagacaaaaatagccggcaccgtccgtgattttgacgcagaagaaagatggggcagaaaagaagcgagacggcttgaccgtttcagccagtttgctttagcggcagcggaacaggcgcttgaaagctccgggattcagctcgatcagattgaccgtgaacgcctcggcgtgtacgtcggctcgggaatcggcggcatcacgactttgattgataacgttcatactttaaatgaacggggagcgcgaaaagtgagcccgagccttgtccccatgatgatctcaaacgcggccgccgctcaaatcagcatcagattaggcgcgctcggcccctcactttctcccgtcaccgcgtgttccatcggcaatacgtcgatcggggaagcattcaacgccattcggaatgatgacgcagatattatgtttgccgggggagcggaagcggcgattacgaatttgtcattagccagcttcggcaatgcccacgcgctgtcagcgagaaacgaagaccccgccgcggcaagccggccgtttgacgctgatcgcgatgggtttgtcatgagtgaaggcgcgggcatcttagtattggaatcattggatagcgcaatcggcagaaacgccccgatcctctgtgaggtgctcggctacggcgcaagctctgacgcgtatcatatggtggcctcccatccggaagggacgggcgcatacctggcgatgaaaaatgctttgaaaaaggcgaacgtttcagcggaagacattgatgtcgtaagcgcccacgcgacaagcacaaaagccggagatctttctgaaacattggcaatcaaaacattattcggggagcttgcgtatgacattccggttacggccaacaaatcaatgctcggccacatgcttggcgcggcaggcggcgttgaagccatcgctctgacagaaagcctgagacacggcatcatcccgccgacgatcaatctgcagcaccctgattcggcatgtgatttggactatgtgtcagacgggccccgccatcaatcgttaacgatcggcctttccaactcattcggctttggcggacataattcggcgatcgtgctgaagaaatatgaatagcgggcatcaaaaaaaggagtgaatcatttcactccttttttgctttctccggttttgttgttaaggcaaaaaaagcgatggaaccgataacggatgtcgtgaacataattgcccccatcggcacggccgtcgcttcattcatccccacaagcggcgacacgatggaaccgagaagaagcggaagcatgccgagcagtgcgcttgcgcttcccgcgcggtgtccctgcttttccatcgccaatgtaaaggtgcttgtcagcgtcatgccgatcgtaatcatataaataaaaatggaaatcaccagtgccgccagcggtccgtgaatgatcgtcatgacgagcagaacggcagtcgccgtcatcgctgtaatcacgccgattttcagcaggcttttttcgtgaatgatcccgccgaaacggccgatgataaagcttccggtaatgatcgccagaccgtttatgccgaataaaacactgaatacctgaggcgatactccgtaaatatcctgatacacgaaaggcgttccggagacatacgcaaagctcccgccgtgaataaaaccgaccgtcagcgcatagccgataaatgaccgatccttcagcaggcttcccattgtccgcacggaatttccgatggagctcggaatccgcttttccggcggcagggtttctgtcagcttgagcgcaatgatgagaacaagcaaaaacccgataaaggttaaaaacagaaaaatcgtatgccatgatgcaaacggaagcaataaaatcgcgcctcccgtcatcggcgccaccatcggcgcgacggcggtaatgaccatcagcagcgagaaaaatttagaaagttctcttcccgtaaacacatctctgacgattgcacgggataaaacgagtcccgccgaagcggtgaatccttgaagaaaacgggcaatcaccagtgttgaaatgttcggtgcaagcgcgcaaaacagagaaaacaaagcaaataaaaaaatacatagcaataacggttttcttcttcccttcgcgtcacttaacgggccgacaacaacctgtccgattgtcagtccgatcagacaagcggttaaactgagctggacaagcgaagcgcgggcgcttaaatcttcggcgatttcagggaaactcggcagatacatatctatattgagcggccccagtatcgcaagcattccgagaagaaaagccagcgcaagccgctccttaccggtcggattatgcagcatatcgttcccacctttcctttgtcaatctctcaaaacatttgtatattgtatcataattttttctttatttttaaaagttttcaaagggcataaaaaaaaccaagggctgtaacagcccttggttccgggtcacgcggtaaaaggttttacgcgtgtttttctttaaatgcttttgcgtattgatcagccgctataatggcgtccgccacgtcgtcagccgtcacgtcaaaagcggcatgaatcgtttcttcttcaatcgtcgcggcttctgccactttcataatgtcctctttagatgcgtctttcattttgatgtcttcaagtgtgacaggcagccccaagctgatataaaacgcgatataccgctcaatttcctcaagcgaacgtttttccagcgccaattgaacgagcgtgccgaatgccactttttcaccatgggtcaagtgatggatttcaccttcaagcgcggtaaatccgttatgaatggcatgtgccgcagctaagccgccgctttcaaatcccagtccgctcagaagtgtattggcttcaaccaccgcttccaatgcgggcgtaacggctttcgctttcacagactcataagcgagacggccgtatttgaataataccgcttcacatttttccgcgatagcctctccggcgattgtcggaattccgcctgccatcgttttaccgccattggcgatgacactgcgcgcctctatccacgtcgccatcgcatcggcaatccctgatgctaaaaagcgcggcggagcttccgcgacgattttcgtatcgaccagaaccaagtcaggattcttatgataaaaacgatagttttcgaacgcgccttgttcagaatacacgacagacagcccgcttgtcggagcatccgttgaagcggccgtcggcacgataacggtgtagccgtttatttcatctgatacggctttggccgtatcaagcgttttaccgccgccgactccgatgacaatagtcgcccctgctttttctgcgatgccggcaattcttttcatttcttcctgggaggcttcgccgttgaaaaccgcctcttcagaagagatattgcttttctttaattcagccgtcaccttgtggcccgcgatatcccatacggttttgtccgcgatgacgacggctttttcaccaacgccctccagatgtccgccgatcgtttcaatggcgttttttccctgcacgtatttggccggactgataaaaattcgttccaatgtcatcatcccttcttcgttgtctctcattacatttctcttattgatagagcggaaatgaaaactcttctgatataattcctcgttttaacttggtttaaacctcatatacactgcagaaaatcaattttcacggcattgacaagatgtgaaggtgtctatataatcttcgatattgaagctgatcattctttactgaatgaacaaacgagattgtgaatgattcgtcttaaaaattatttagttctgctggataatttttgaggcgtttttgttttatatatatttttgactgcggaggaggtttgcacatgaagaacatttgcaaggatatactgatgattatggccggagcctttcttatcgcggcgtccgtggaatttttcgtcatcccgaatcatttaggggacggcagcaccgtgggaatcgctctcgttttatattatcttttccatatacctgcaagtattacgactctggttgtaaatttgatttttatcgggctggcttataaatttttaacgaaaaaaacgattttatacacgatactcggtacgggaatgacttctgtttttctcagcatcgtcagctttattccgttcggcgtgcacgacatggtgctcgggattgtattcggcgctctgctgatgggagcggggctggcattgatctttatcgctgacggatctaccggcgggaccacgcttttggcgtatttattgaattacacaaagggctttaacatctccaaaagcatgttttatatggattgtgtcatcattttcgcatccgttttagcgatcggaatcaatcatatgctgtatacgtttatattcgtttatctgtgcgccaaaatcgtcgatattgtcattgagggtttccataataaaaaagccctcaccattatgtctgaccaatacgaagaaatcgccaaagccatcacctccgagtacggcaacgcggcgacgattttttacggatacgggtattacggcagcaaagacaagcgcattatctatgttgtcattaaaaagaacgaattgctgaaaatcaaaaaacatgttcaaaaaattgatccgaaatcatttatcgttattcatgaagtaaaagaagctgtcggagggcaattcgggtttacaaacctgcccgccgccgcaaatgaaaaataaccgcctgcagtgtatagctgcaggctttttttattcggctcttccccgctcaaaggttttttacatctttcaatcgaagtagtaaatgaaaccttttttgatggaggaacataaaaaaatgaatatcaaaactgaaaggctcgtcattcggacatttgaaccggaagattggcaggatgtctatgcgtacacctcgaatccgagtgtcatgaaatatataccagagggtgtctttaccgaagaagatgccaggaaattcgttactgaaaacagcggtgaacatgccgggaagtttcccgttttattgaaggatgagaaaacggtcattggccacattgttttttttcagtattttggcgatcatacgtatgaaatcggctgggtgtttcacccggaataccagggcaaaggatatgcttcagaggcggcgcgcgccgtgctggcattcgggtttaacaagatgaaattacaccggatcattgcgacatgtcagccggaaaacatggcttcgcaccgggtgatggaaaagatcgggatgaggcgggaaggcttgtttaaaaaatgcatcccccatgataatgaatggtgggatgaatattattatgccgttttagaagaagagtgggaagcctccgatctggaataaaaaggcttataccctttgcttttacagataagtgtgtgctacactgttcgtaacaaatacgaagggatgatgggtggacaatgattaactaatcttattttgaccgtttgaaatcaaatatttcaaatcagaaaaaataggattagtctgcccattttctatacgatacgagaaagctatgtaaaaatagcttatttgatcacgcacaggtacggctaatccttccaaatcaattgggaggatttttttgtcctccctttaaagcgagggattgacatatgaaagaaatgttaaaaataagcggcatcagttacgaaatcaacagcgttcccctttttgaacagatcagcgcgagtgttcagcaaggcgacatcatcggtgttatcggtaaaaacggcgccggcaaatctttattgctgcaattgatctgcaataaaaaagcgccgtcacaaggacagatccagatgatgcaagatgtgaacatatatatggtggaacaagaaacggaagcttatgattccggccatccggagcctgcggaggcagccttgttagaaaagtggaacgtgcccgcacgcgccttttcgcaattaagcggcggagaaaaattgaaagcccgtcttgccaaaggtttctcctcctcaagcggccttttgttattagatgagccgacgaaccacctcgatcagcacagtttagaaatactgcttaatcagatcaagaattacaaaggcaccattattttcgtttcacatgatcgtgcttttatagatgcggcggcgacaaaaatctgggccatcgaaggaaagaaactcattgaacataaagggaattattcaagctatatggaggtccgcaaacagagaaggctgacacagcagcgggaatatgagaatcagcagcatatgatcagacggattgaagctcaaatgaacgagctgagcgcctggtcaaaaaaagcccacgcccaatcaacgaaaatagaaggctttaaagaatatcaccgcgtaaaagcaaaacgcacggacgcccagattaaatcaaagcagaagcgtcttgaaaaagagcttgaaaaagcgaaagcagaaccggttgaagcggagtatgaagtccgtttttccattgagcaccgcaaaaaagcgggaaagcgttttttagaagtaagtgatgtcacaaagtcatatgaaggccgaacgctttttaaaaacgtgaatttcactgtgatgcacggtgaaaagatcgcgattacaggcccgaacggcagcgggaaaacaacattattgaaggtcatcctcggtcaggaaaaagcgcagggcggcatatggatttctccgtctgcaaacgtcggctatttaacccaggaagtattcgaccttccgcttgataaaacccccgaacagcttttttacaaagaaacgttcgaagcaaggggaaatgttcaatccctcatgaagcatttaggatttaccgcagcgcaatggacggaacccatcggcaagatgagcatgggagagcgggtcaaatgcaagctgatggcgtttattctgggggagaaagatgtgctgattctggatgagccgacaaaccaccttgatctgccgtcacgcgagcagcttgaagacactttggcccgatacgacggaacgctcatcatcgtatcgcatgatcgttactttgtcgaaaagacgacggacatccggcttgatatctcaaacggcagcgtccgaaaacaatggaaagaatctccctccgtcagggatgatgctgaagaactgcgattaaagtttgaaaccgaacggcaggaagtcctcggaaaactcagcttcatgactccggctgataaacaatatcgtgagcttgatcaaaagttcaaagagctgacggaagaaatcaagaagttgaaatgaatgtaaaaacccgtgattgtcacgggttttgttttggaaagttcacgtattatgaagaataatttcaaactgatttgtacaacctacgttcagattcatacgagaaggttcagaaagaaaggttcaggtgaacgcagaatggccaaacgcatcggaattacgggaaacattatggctgatcaatccggccctttcccgggttataatcgggcatatgtcaataatgattatattcagtctgtttctgaggccggcggtgtgccgtttatattgccggtgattcaagagacggcgcttttaaaggaacaggtctctcatgttgacggcatcattctgtccggcggccaggatatagacccgctgttttacggcgaagaacctttacaggctttaagaaagacctttcctgatcgggacgcctacgaaaaggagctgattctcacggcggttgctttagaaaagccgatactggccatctgccgggggatgcatatgttaaacgttacttacgggggaactttatatcaagacctggcacacgcttcgtttgctgacattaagcatgaccaagaaaaagatccgccgttaaaaacccatcatgtttcttttgaaaaagggacacgtctccataccttgtttggcgattcagcgcgggtgaattcattccatcaccagatcataaaagagacggcgccttcatttaaagccgcggcttatgcgaaagacggggccattgaagcgattgaacgaacgggtgaattatttgtcgtcggcgtgcaatggcatcccgaaatgctgacaaaaaaacatgaagacatgaaaaagcttttttctctgttcatgaatgcggtcagcacataaaaaaagcagatcataacgatctgctttttcattttattcttccggtttctccggtgttttgccttgtgtcagcttatggccttcgatatccacgttcggaatgattttatccagccacttcggcaagtaccaggccgcatgtcccatcagcttcatgacactcggaatgatggtcattcttacaatgaacgcatcgaaaagaacaccgaaggtcattgccaaccccatggatttgatcgtagagtcccccgcgaagatgaatcccgcaaagacgaaaatcatgatcagtcccgccgctgttacgacaggtccgctatgtttcaatccggcatggatggcttgtaccggattttttgttttgacatattcttctctcattctgctgacaaggaatacttgatagtccatcgccagcccgaaaagaataccgatggctaaaataggcaggaaggcgagaatcggacctttttccggaatgctgagcaagccggtgaaattcccatcctgcagaacgaataccgataacccgagtgtagcggtcatcgtcagcaaaaagccgacgacggcggcaagcggcacgagaagcgagcggaaaacaacggtcagcaatacaaacgcaaacccgacaataagaatggcgaatttcggaatcgcatcgtttaaccggtctgaaatatcaatattcaccgctgttgacccggtgacgagcaggcggatgccgtttttgtctgatcgtttccgtatatcctgcactaactctttcgttgccttatcattcggcccggtttcaggcactgccgtaatgatggcataatcccctttttgattcggcatggcaggtgtgacgctcgccacattgtgcaagtcctttatttctttcacggcgtcttgaaatgcttcacttttattccccttgactccttttgcatcggcaacaattgtcagcttgccgttaaagccttcgccgaatcctttagacaacagatcataggcgcggcggtccgggctgtctttcgctttcattcccgcatcaggcagccccagttctaaatgcatggccggcagactgatgacagctaaaagaataatgctgaaaatgcttaacagaataggcttctttgtaacgaagcgtccccaggcattcgtgtcggcgctttccttttctttcttcttgtttgatttcggaatcatccgttttcctgcgattgacaacaccgcaggaaccagcgttactgatgccaatacagccatcagcacactgagtgccgcagtcaatcccatcgcagacatgaacggaatgccgacaacggtcaatccgcaaagcgcgacgatcacggtcagtcccgcaaaaacgacggcgctgccagccgttcccgcagctttagcgatcgattcatttttttgtacaccttcgcccaaaaactgacgatgcttcgtaaagataaacagcgcataatcaatcccgacggccaggccgatcattcctgataatgagagactgaccgaggctatcgtaaagatctgtgtcccaattaacgtcagcgcgacgcttacacctaacccgatcagggccgtgacaatcggcagccccgctatgactaatgaaccaaacgtaatggccagaacgacgaaagccagcacaacgccgacaatttcagatacaccgccggcttcaacaccggcccccggcacatcgccgctgagctccgtctgcaggcccttgtctccggcggcggacagactgtgtttaatatgtgaaacagacgcatccgtaatgtcatccgccgcttttttgtacgtaatatcggcatatgccactgacccgtctttagaaatggttcctgtttcaaaaggatttgcaatcgaagcgaccgaatgatctgttttgatcttctttaatgtctcttcaatcgcttgtttttccggttttgacgtcaatttcttcctgtcttcagctccgaaaataacccgtatgcttcctttatcgggcccctttgaaaattctttttgaatcacatccatcgccttttcagaaggtgtgtcgggaattgacatatcctcagaaaaagcaggttttaacgagatggcgatcacaatcgaagcgatcagtatcacgagccacgcactgatcattttgaatcggttgcgggcagaccatccccctaatttatataaaaaaccagacatcgaatactcctctccaatcattactttctgcctaattgtagttcacattcacataaaaaaaacgtacataggggcatgtacgtttgggcagtttttcattatatattcagtttcagaatgcctttttgcatagcaatggtgacggcttccgtccgcgaatcagcgcctaatttgttataaatcgatgttaatctcgcttttaccgtccgctctgagattcctaaatcgaaggcgatcgctttgcttttatgtcctttcgcaacggcttgcagaactatgatttccttgtccgtcagctgtgtttcattggcatttgcccgttccattttcttttcccggaaacgccgcaagatgtccggctgcagaagcacttctcccctgaccgccgcatccatcgtatgaaataaggtttctgagcttgtgtccttcagcagataaccgttcgcgcctgattcgatgccttctatcatcagatgatcttcattataggtcgtcaaaataataatcggcacatcagaatgctcttttatctgtttaatggcttccagcccgctcatttccggcatgtacagatccatgagaatgacatcgggctttagttccgctgcgaggcggacggcggttttcccgttttccgcctctcccgttatggtgtaatggtcatttgtttctatcaaaagcttcagaccttctctgacgacaagatggtcatctgctattaacactttatacatgttccgcttctccttgaattggtatgatgatctcaatttgagttcccgctgatctggcgcttgttatacggaaagtgccgttcatcatattgacgcgttcttgtatccccagcagcccgtaatgtccgctttttctcatttctgttccggcatcaaagcctttcccgtcatctttgacggttatgcggatctgtccctcttcttcctgaacggacacccagacattctttgcttctgcatgcttggcggcgttagtcaggccttctccgatcatgtaatggcaattctccgccgtatgaacgtcaagcacatgatgcacgctgtaatctaaaaaacaagacagcccggaggcttctgtaaaatggttgatttgttcagtgatgctttcttttaagaacccgatctcttctgatttgctgcgaaggttgtcaatggccgagcgcgcatcagccaatgtgcccttcactctgtccattgactggctgatgatgtctttcgctctgtcagtgttaccctttgaaagatgaacatgcaccgcttcaagctgcatatgcaagctgaccagcccttgtgcaagtgtatcgtgcaagtctctcgccatccgctgcctttcgttttgaagcgtcagctgtttcacttgccggtgagcgagctctaatttttcaagcgtcatctgtgttttgattttttcatcaacttgcgcgaaaaatgttgccgcatatgtgataatcacgatcatgatgggagcggcgataacgatgaaacgaagcagatgatgcggatgctcctggtgcagggctgctatggacattaaaatgaaaagatagagtatgagcggcgttttgcccttatccgccattccgataatctgcccgattaaaaaggcatagagaccgatgaccgccgcgatatagccgccggtcatcaagttagccgatgtatatatgataaatccctgtatgatgaaataaagaaacgtttttttcttgacccagcgataggaatgccagtgcagcacagcaaaaatgacgatcaatatcgtgaataacagcagcaataaaaccgtccagctttcataaatgtactgcaaagagactgatgcggcatataccataaaaataaacgccagaccgggcacccgaagcgcaagcatatgcaatgagcgtctgtcacgggagacatagtcttcttgatgttttgtaccaaacaatctctgtccacttccttttagccgaccggcctcacgatgttttattctatttgtcatcataccataatcgcctgcttctcaccttccccttctgtcctgcttgacgggtgaaagaaaaaacagcctgcgggattgttcgcgggctgcttttgttcatatcttttttatgacctttcccgggtttcagcggtctgtctcccgcgcggcaaaaccgcccgcgcatcagaaaaacgttcaggacaccgacagccattccatgtgaacaagaggaagcgattgtgcttcctcttttttaatgtaccgtcaaatttcttctctctttttttataaacaaaatttgtaagactagagctcttttctcaggggaaattaattatgtaattgagaagaggaggtttaaaaaacgattatggaaaagcgtgaattagcggctcacgagtcgctggacttacatgaaatcattaacttcaagacgctttgtgtagcgaaatccaagctcatgcaagggcttgtgtttgatcaggatctgaaaacgttaatggaaaaagacgttcagcaagcctcgcaaaaccttgctgatctgcaggcggtttatgaacgggcaacgtttcaggctcctgttcctcaaaaccggccgacttcgatcatcaattgaaaggaaggtaagcatcattgaaccatgaccatttagatccaatcaattcattacacgtccctgaactcgcagatatgacattcgcaatggattttctcatacgcgcaaaagaaggcgtcagaaataccgccgttgctttaacagaaaccgcctcgccagatgtaagagctttgctgcgcaaacagctcatgcaaggaatcgcgatgcatcaggaaattacagacttgatggtcagcaaaaagtggtttcacccgcatgatctgagcgaacagtataaactggaccagctctctgcgaaaaataccctcatggtcggaaacatgaatctgtttcccgttgaaacgaacagaaaagggatgtttgaccgcacacctgatgaacactaacactggaggtattacagcatgaaggccgtaacgtatcaaggagtgaaaaacgtcgtcgtcaaagacgtgcctgatccgaagattgaaaaacacgatgacatgattataaaagtcacaagtacggcaatttgcggatcagatttacatttaatccacggactcattccgaacttgcaggaagactatattatcgggcatgaaccgatgggcattgtggaagaaaccggtcccggcgtgacgaaagtcaaaaaaggcgaccgcgtcattattccttttaatatcgcctgcggagaatgcacttattgtaaaaatcacctggaaagccaatgtgatcaatcaaatgaaaacggcgatatgggcgcttatttcggctattcagggagtaccggcggctatccgggcggccaggccgaatatttgcgcgtcccttttgcgaactttacccattttaaagtccccgaaacatgcgaagaaccggatgagaaattgagtgttattgccgatgcgatgacaaccggtttttggagcgttgacaatgccggcgtaaaagcaggcgatacggtcatcgttctcggctgcgggcccgtgggccttttcgctcaaaaattctgctggttaaagggtgcgaaacgcgtcatagccgtagactatgtcaactaccgtctccagcatgcgaaacggacgaataaagtggaaatcgtgaacttcgaagaccacgaaaatacgggcagctacctgaaggaaatcaccaaaggcggcgccgacgttgtcattgacgccgtcggcatggacggaaaaatgacagatcttgagttcctcgccagcggattaaaacttcaaggcggggccatgagcgcattggtcatcgcgtcccaagcggtgcgaaaaggcggaacgatccagattacgggtgtgtacggcggcagatacaacggatttccccttggcgatatcatgcagcggaacgtcaatatccgatcaggacaagctccggttatccattatatgccgtatatgtttgaactggtgtcaaccggcaaaattgatccgggtgatgttgtaagccatgtcattccgctcagtgaagcgaagcacggctatgagatgtttgacacgaaaacagatgattgtattaaagttgtactcaaaccttagagaacggaggctacagaaatggccagcgccttacatgaattactcgaaattcaggagatggcttcttttaagtcactttgcctgacgaaatccaaaaccatgaaagcgctcgtatccgatccgcagctgaaagaaatcatgcagcaggatgcggatacatcaacaaggcaattgcaggaatttgcctcgattttatctgatgcaaagcacgaataggagatgaatgacgaatgaatccgattattgaatacctgacggggatggatgcactgacagaccaaattgtcgctatggatttattgaattcggcaaaaagcggagtcagaaactatgcgatggcggcgacggaagccggaacgcctgaagtgaaagcgatcctcacccgtcacttagaagaagccatcgacatgcatgagcaaatctcacgctatatgatggaaaaaggctggtatcatccgtggaacacagatgaacaagtccggtttaatttgcaaaatattgatacggcgctccgcctgcccgtcctataaatgttttcctgctgagacagcacctctggctcagcttcagtatgtcaaactgagaactgcctttacagcgcccaggcaacgaaactcccgcgaatcagctctgcagcttctccagcctttcttcgggctgttattggggcttgcggcggtgattacgtgcgtggcggccgccgggcggttcgcaaatagagcgaagaaggcagaacaatttgttctgccttttcattattttctgccccataggcacaaatacttttcacccgattcgagcggcggttattcacgtagcttgaactcccttaaacgcactcatcacaagatcatgcacataggaatcattcacctcatcacctgtgatcaacaggcgatagaaaatcggtccgtaaatgagatcgatgcttacgtcaatatcaagattctctcttaattcacctttctgaattcccttttccagaaggcctttcgcttggaggcggcggggctggaaaaatcgcgtgcgatattcttccgccaattttgcatccagctgtcccgcaccgattaattccttaataacggttccttcccggctcgtcaaaaaccttgctaaattcgcggcgtgggtcaatatatcttgcactgttgatcctgtatcgggcacaggcagtctgtccgtagcggtcgaaagaaagctgtccatgataacggcagccttgtttgaccaccatttataaatcgttgccttactcactttggcacgctctgcaattttatcgactgtcaccgcgtcaaagccattttccaacaataggtcataggcagcagaaagaatcgccttatgtgttccttcatcacgcggccgtcctcgtttactctgcacatgaatcattccttcccgaattataaacgatacgttcagtatacttaacctgtataaaaaaagaaaacagaaacccatttacaaaactgaacgtttagtatattattcacttataaacaaaactgaacgtttagtttataaaataacttgagggaagtcttgatgaaatgcagactccaaaagcctctgcgtaaaggagatgaatcagcaaaatatttatcaaacctcataaaatcattaaaaaggagttcattcatatggctaaagaaaataaacaaacagcggatcaggggatttcaactggtttaacccttcttctcgcaacggcatgcggtatcattgtcgctaatctttattatgcacagcccttggcaggattcattagtgcggcaatcgggctttctccaagcagtgccggattgattgtcacgctgactcaaatcggatacgttgccggcctactgtttctcgtccctttgggagatattatcgaaaacagaaaacttgtcgtggtatcgctcctactaagcgcagccgctctaactctgacagcatgtgtgaagcatggaacactgtttttagccgctgcgtttttcatcggactgggatccatcgcggcccaagtgctagttccgttcgcatcataccttgcaccagatgccgcacgcggccgggttgtcggcaatgtgatgagcggcctgcttctcggtattatgctttcccgtccgatatccagtctggtcgctgatatatgggggtggaatgccatatttgctttatccgccgcgttaagtgttgtcctggcaatcgtcttatcaaaagtgcttcctgccagaaaaccaacagcaaacacaagctacaccgtcttactcggttcaatgtggaagctgctgcgcacgactccggtcttacgccgccgtgccatttatcatgcgtttgtatttggagctttcagcttattctggacgactgtacctttactattgtccggtcctgcttttcatttttctcaaaaggcaatcgcgctgtacgcattagcgggcattgcgggtgcagcggctgcaccgataggcggccgtctggctgatcgcggcttaacccggcttgccaccggaatcgctctcggtgttgtcatcgtttctttattactcccgctcatgattcagagcagctctcccgtcggaatagcagttctggtggccgcagctatcctgttggatatgggggtatctgccaatctcgtactcagtcagcgtgccattttttcgttggcacctgaattccgcagccgattaaacggattatttatggcaatcttctttctgggcggcgctataggatcatcaatcggaggatgggcatacgcctcaggcgggtggagtatcacattatggattggaatcgcttttccggtcatagcattgctttatttcaccacggagaaataagcctttcaccaaaaataagccgtcaggaccaagctgacagctttttttggggtgtattcttctttacatccatccgaacaaaacatccggattcatgaaaagatgatattgattctttacgccccgctcatatagacgggcgcatgcccgctgccgattctttcagcagcggtaaaaccatgtcataatatgtttagaaataattgtccataggcaggtgaaacacatgaagaagtatttatataaacaccttttgttagctctcgtttcgtccgtttgctttttattggtcttttatgtgggtttaaaaatgacacaggaagacacacccccgttgtcttcttacccgttttacctttttatttatctttacatagcagccggatatttgacggtcggccttgtttcagcctgtatgactgatatcttgaaaaaccgctggacattgaataaaacgtcttccattctattgaaacttatcgtttacttactcataccgtatgctatttttcattctttcttcattttaatggcgccgttgatttatgtgctgttcgagtcgttattcatcctgagaaaagcttcataatcagaaaaaaacataccgcatgctgccggtatgtttttaacatgcttgtcagttttttgcggtgattcgtttgatgttttcttccatcaagccggaaatgagctgttcgtttgtatgaggaatctgtttgagctgttgtacgaccagcccttgtcttgcggctgaatgattttgactcagctttgcctgtccctctattttgctgattttgattttaaaaccttttacccctttgttcatgcctgccagcaatttcgcatcgacatcctctaatttgtacgggctgtcggggctttcgtatttcaatacgagatcactcatcgactgcacggtttcttcctcatccaaaagctccgcctctccgtaaacatgaaccgccacataattccatgtgggaacagcctgattcgtctcataccatttaggcgagatataacaatgaggcccctgaaaaacggctaatacgttttggccatcaatctctttccattggggattcggcaatgcaaaatgaccgtataagcattcgttattcttactcatcatcaatggcaggtgggttgcatacggcatgccccccgccgttgaaaacaatgctgcgaaaccatactctttgattacatcgcacgcttcagcttcactcagctgaaatggagccggaatatacatacaaaactctcctctctgaacatggattgataaagcgctttccgctataataaaatatcaactgacatttaaaaagatacagtttcaaataaatacacatgtcagaggagaacatctgatgaaaaatttgattttcgctttcagaagcggcaccccgaaatacaaacaaatttacgagcaatttaaaacattgattgagcaaggaaatattcaggcagatgagcggctgccttccattcgcgagctggcggattccctgcgggtaagccgcaatacaacgctgatggcctatgatctgcttttagcggagggatacattcgcggagaaacacgcaaaggatattttgctaatgaaatagaaccctctttatttcaacaagaacatgatgttgtttacgctgagaaaaccgaatcaactcagccggccctgattgattttcgcgccggagccgtcgatcaaaagcattttcctctgaaaacatggagaaaattatacaatcaagttttggcatcagagaaaagctttctgtacggtgaaccgttcggcgagagaaacctgcgtgaacaaattgccgcttatctcttggaatcacgcggagtgaaaacagatgcggattcggttatcatcggcagcagcacccagcagatgctgatatatctcagccagattctgaaagaggatttttccggaattatcgttgaagaccctgggtttgacggtgccagagcggcatttcaatttcacgggctatctctggaaacgatgcctgtctatgaaaacggagctgatttttctcaattgcatgcaatgaaagaaaaattaatctatgtgaccccatcccatcacagcccttacggcgtaagcatgtccattcagcagcgccaaacactgatcaattgggtgaatcatagagagggttatattcttgaagatgattatgacagtgaattccgttatacacagcagccgtttcccgctcttgcttccattcaatcagaccgggtgatttatttagggaatttctcaaaatcctttctaccgggcatccgcataagctatatggttttgccgcagcgccttttgcaccggtataaaaaacggtttattcatttcgaaagcaccgcttcttcgcttaaccagctgaccatggctgaattgatgaaggccggtgaatggacccgccatattaagcgcatgcgcactgtctacaagcgtaagatgcagcacttgacttcacatatcaagcagcagttcggcgatcaggtgacgatcatcggcgagcagtcgggattgtatatattagtaagagttcacctgaactatacagaagaaacattaatcgaacgcgcctttcagtacggagtgaaagtataccctaccgctgtctatttcgttgccggaaagcccgaaccgccgatcataaagttaggtttcgcccatctcgatacggatcagatcacacaaggcgtacagcttttgagaaatgcttggctgtcatgaaagaaaaaaggcgccgaacggcgcctttttttatcttttatttcgtatttcttgggaatttcggcagtccaaatataatggcggcgatgccgcagattccgattaaaacgggatagaaagagtatggcaggatgctgacgggtgaaatattcccgaatttcccggctgataacagctgcgcgccgtaaggaatcaatccttgtatcatacacgaaaagatatccagaatacttgccgattttctgttgtcgatgttgaatttatcagcaatattctttgcaatcggcccggctgcgataatcgagatcgtattattggccgcagccagattcgtcacgctgaccaatccggcaatgccggcttcggcgccttttttggaacggattcgtttcgtgatgaactccagtaaaaagtcgatcccgccgttttgtttcatcacaccgaccattccgccgatcagcatggacaggatgataaggtcgctcattccggcaactccatccgtaatcgctttaaaataagaatcaaacgtcaggctcccgcccgccaatccgatgattcccgtcaaaaccaatccgccgaatatgacagccatcacattaataccgattaacgcaaaaactaacacggcgacataaggaagcaccttaatccagctgtaagatgcagcatccgtatggagggcgtggcctgccggaataaaaaataagataataacagtcacaatggcagcgggcaaaacaatcagaaagttcgttttgaatttatccctcatttgtgttttttgcgtccggactgccgcaatggtcgtatctgaaataaaagaaagattatctccgaacatagctccgccgaccacagccgcaatcggtatcgcgctggagatgccaagctctccgctcaaaccggcgctgatcggcgcaaccgccgcaatcgtgcccattgatgttcccatcgatatagaaatgaaacaagcaatgataaacagccccggcagcaaaaactgctgcggaataatgctcaaagcaagattgacagttgaatgcaccgctcccatcgcctcagccgctgaagcaaaggcacctgccaatataaaaatcataaccataatgataatatcaggatgtcccgcaccggaagcgaaccattctattttttgattgagcgatttcttccggttaaataacagcgcaaaagctgacgcaatgatcgcggcaatcaagatcggcaatttataaaaatctccggtcaccagaccagagccgacaaaaagccctacgaataagactaaaggcaataacgcccaaggattcttatgattgttcatctgggtaaaccacctcttttcagcattaaagtcgctaatcacagtctaagcaacatttcacactttaaaagtctgcagtaaaaaagtcaagctgaaaaaaggataagtaatgattgataagatagaaaaagctgttttgtttcctctctttagaaaataaaaaaaaccaaggctcgtttcccttggtacatttcatgcggcccggcgcccgggacaccttctcttcattcagaaatacattcagctttcaatctgtttttaagtttcgcttcattttccaggatatcttcgtaatcctcaatcttcctgtttaatcgttttatggtttcatcaatttccctctgtttctccgtcagccttttcctttcatttataaggatgttttttcggggttcgatcgtatgatcggctccttcaataaataaagcggtatattcaatcagcgcctcaatcgacagcccggcacttctcatgcattttataaattgaatccaattcacatcatcttcgtcataatcgcggatgccgctttcatcgcgttttaccggaggaatcagtcctatactttcataatacctaagcgtcgcggctgataactcaacctgctttgcagcctgcgcaatcttcatattcttaccacccatccttcatacctttcataagcgtgccattatagaatatcatttcataaaaaaataaaccaaaccccttgacttaaagtccgctttaacatttaaagtaaaaccgaacagaggattcatcactttatcttggaaaggaagataaccatgtgcaataatcatccgactcgtgtattaagcgctccgcatgccaaagctaaatttgagcggacgacgattgagagaagagcattacggccgcacgatatcctgattgatattaagtacagcgggatttgtcactcagacatccacagcgcattcgatgaatggggcggcggaatctttccgatggttcccgggcacgaaattgccggagttgtggaagccgtgggtgaagaagtcaccacatttgccgccggcgaccgtgtgggtgtcggctgttttgtagactcctgcggggaatgtgaatactgcctgaacggagacgaacaatattgcacaaaaggcgttgttcagacctataataacctggactacgacggaaaccctacgtacggaggctacagccagaaaatagttgtcactgacagattcgttgtccgtattcccgatcagctggatttggatgctgccagtccgctattgtgcgcgggcattaccacctattctccgctgaaacactggaatgccggtcccggcaaaaaagtggcgattgtcggaatgggcgggctcggacatttagccgttcaattcgcgcacgctttaggcgcagaggtcaccgtcctcagccgctcaatgaacaaaaaagacgaagcgcttgaatttggagccgatcattactttgcgacaagcgatccggatacatttactgagctggccggacgatttgatcttattttaaatacagtatccgcgaaccttgacgtagatgcctacttatccctgcttcgcattgacggtacattggtaaatgtgggagcgcccgctaagccggactcatacagtgtgttctccttaatcacgggccgccgcagcattgcgggttcactcgtcggcggtattccgcagactcaggagatgcttgatttcgccgccgagcacggcattgctcctaaaattgaagtgataccggccgatcaagtcgacgaagcgtacgaacgggttctccaaagcgatgtccgctaccgtttcgttattgatattgcaactttataattctcataaaaaacataccaatatctattggtatgtttttttcagcccagattattttttatttcagcagccatccgggcaccgctttgatataaaccaattcaccgatcagctcaacaatcgtctgtgtgacgataacagcagcggctaatgaggcccaagcatccggcaaagccagcgctaacggaaggactgcgagagaattccttgtgcccgtgctgaagatcaatgctcttccttcacctgtatccagacggaacgcatatgcgataaaacgggagacaaacggcataatgagcaggaatagcagatagatcggaatcacacgtataatgatgtcagcatcattgatgactttgccgatttgtgtggcgacgaccgccaataaaaccagagccataaaaggaacaggcagccacgccgtccattccaacaccttttctcccgccggtttcttatcagcccataattgagtcatcaccgccgccagcagcggcaccgctattaacaataagaatgcttccagaaacggtcccgcatgaacagctcctatcacttctttcccgataaacagccacaggtataacggaagcaataccatctgaacggcgaacaaaaccggcgtggaagccagtattaatctctcatttcctttgccgagctgagtaaagacgatgacgtaatcaatacaaggtgtaagcaataccaaacaaacccctgataatataggaggagattgaggaaaaatggcggttaacacccatacaacgacaggtacagctaagaaattaccgatcagtaaggccgccataaacttgaggtttgacatggcttccctcagcttcaagaatgggatttgggcaaacatggcatacatgagaacagcgataaacagtgatatcgtccatccccagcgaagtcctgaatctttcccggcgatccccgctattcctccgatcacaagagtcacaccatatatccaaatttgctgtttttctaatgtctctctggttattttcattggctgacacctcttccccgcccattataccttcttttctgccggaattaaaaaacaccaagggtctgtgacacttggtgttttcaggacgtgttattgttgtcaaaaccgcttacgaaagcttatttgtgttctctgtcctgccaacgaataaggtgaccgcaacactcgctgaactgaccaaagtccccagaacggcagcaagaattgtcaaaaagccattgggaatcagaaatccaatcggaatgaggcccgcaaacgtgagaacgataaaacattgatagactccggatatgattctcacaaccaagctgctaaaaaaggacatgacgaatggcggaatgaacaaacataaaatgattccgagtgagatcaataaaatcataggctcgtcaaaagaaatgacacgattgccgggagactcttcagccgccgcgaatacagcaaatatagacatcatcagcgtaagaaaaacaagaaaaaaccttttcagcaacgttatgactccttttttataaaaacgggtatctttttttcaatcacaataaccattttatgttatcaaatgaaataatatgaagtcaaaccgagttctgcacctgatttatcggttcttatttttttgataatttccatataattgtccgcaagcagcatctatatcaatgccaaattgacttctgacggtcacgttaattcctgctgactttaattttttatagaagtttacaacttgtttctcatttacttcttcaaatctcataggtgaactaacagtcgggttatatctaatgatgtttacatggaacaagttccctctcttatatctgcttcttaaaagacgtactacttcattcgcatgatcaatagaatcattaactcccggcagcataatataagcaatataaacttttcttgaggtcacacgtatatgctcatctaatgtgtccattacctccaataacgggaagcgttcatttatcggcattaacttgcttcgctgttcattaaaaggagaatgtaatgaaaacgtcaggttgacctgcggataatcctgagtgatttttttaatgcccggaataatacctatggtcgaaatagataaccgacgagggcttaaagcaaacaactccggatttgtaagcacatgtaaagcatcaaaaacttgtacattcgctaatgcttctcccattcccataaaagaaatactatcaattgaatgtccttttaagtgaaagtacaaaatttggtcagtcatttcatctgatgttaagctgcgttttaaaccaatatctcctgttgcacaaaatgcacagccaaaatgacagccgcactgcgaggatatacaaaatgactcccagccagctttatatttcatattgaccgtttctattttttcgtctcctgaaatttcaaataagacttttgttacttgctcagaatgctgcacttttaaagcagcaatatttaaaattgactctccaaactcattcattaacaattttctcaaggatttaggaagaaccgttatttcattaaaatgatttattctccctttgaacacagcatttttgatttgattcattctaaaatcaggaaacttattttgtttcaggaactcttgaattcttatatacttgtttttttgttgcatgttttctcatccttccataaaactctggtttgtttgagtaaatagaagggagtgatcatctaacctttttttaaaatcaggcacaaaaaaacaccgacacaattatcggtgttacgcttaaataacatcatgcacaaataaacaaggacattatgtcattggattatcgtttatttgacatagagaaaaagcaccgataactgtttttgtatgatgatttggcttaaaaaaggacagactgctccctttatccgccaagatgtttccaatttttgcattttcaccatacaaaattccataaatcgttatcatcgctttcacctctttcttgtcaatattaacaataatcaccatatcataagggttcccttatgtaaagttaaacaaatgcttacgcccccgctaatgacagtattataaaacttgcttattaagcctaatccaagtacagaaagcgcgctgatcacatgtttcacttatccgcgacggaacatttcttatataatgggtgaccggcagctgcctgcttgaatcccaatcttcttatagtgattttttatattcatgacagtatgatgatttgtcacttcagcaatcagatcgtttattcgatccagattaatcggtttattttctgataagctgctgaagctttctctgatttcttcaggatagacatttccggccatgcttgacaggccgttacacccgttactcagcatcttcggaaattcaacgtctcctgccgcaaacaaaataaagtgatcagggaactctgtttgtttatgacgcagaacgtctcctccttctttcagcccccttatcccgggatgccggcttattaagtctttaagcgctttctcactcagattaaaaccggtccggccggggttattataaagcacagcctctttagaggtatgactgagaagttcgtcaacgtaataaacggcttgctgctgtgtcggtcttatataaggaggaaaaccaatcagtacagaatcaatattggttttctcgatgtgtttcatcagtttgacggcatcactggttcttacggctgaaacaccgaacatcagttcaacatcttcaaattttcgctgattaacatactcaatgatctgaagacgctcatctatgctgagtgaatgctgttcaccagtcgtgccgcatatgagtaacgaatggataccgctgtttttcaaatgttcgacaatagcatcaaatccttctaaatataaactttcatcttcatgaaaaggcgtagggatagcaacattaaaatttcgcatgagaatgtcctccaagtacatattcttgaatatctgcagagtatcatataacactgtctgacatttaaaaaggtacagtttcagataacgcaacatgtcagatgtaaagccgacacacaaaaaaagcaggcaaagagagcctgcttcatagcttcgtcttacagcggcccattccccggatggcttgacaaatatgagtaataaggcaaactgatataaaaattgtgctaatgaggtggggttaatgattttagatttaaaaggtgaaacgcacatggatcatcttgtgggaacgctgtattctgccgttaatgaaaatgacagccgcttaatatccattgtgtcagacatgtcacagcaggagattgattataaaggaccaaatcatcaaccattcaatggggaatatggcatatggcagaccataatagatatcatcaagctcatattcatcagcttcgcaaatggtatgaagagaaacagaaacttggcagttaaagccgcttattaggaggagcaacgataaattcattacaaatgtctattttcactgactgccaatcaattaaaatggtcagacaaaaatcgctattacatttgcaacgtatcttaatccggccggcgcagttgtaataaaaaaagaccgctttcccctcttcttcaacgtaactgacatcatcatcttcatttttcttaacataaggttcagcaaatcgttcctcggtatattccacacattgctttcaaatgcaggtgcaattctccttgaaacagcaaatggttgtttggtttattgaattctttcatattaaaaaatggagtcattttaatgatcatatcagtctccttccaaacgagattgcatttacccattatttgttattctgcaactgaatcattatcttttatatcaggaattcttacaaaaaagtaaggtaagtgtaaggtattcgcatttattcgatatgcagtgttcattagaataagaaatataaaaggagtgatgaagaatgaaaaacatgagcattttcattattatattaggctgcctatcggttttcatattaggaggctgcgctgatcaaggcgccgtgctggaaagcgattattacgtacaaattcacggaaaagcggaaaaaaacaaaaataatagcaactacgtttacaatttagaagggtataacgagaaaggtaagaaaaagatggtttctttctttgttgaaaagccttatcaagaaggtgacattgtacgcgttccgaggagctatgagggttataccggagaatctgaagctattaaggccgagaaactgcctgaaaagatcaaagaccgattcaacattgagaaataacagcgagttgagcagatatttaagtctgctctcaattttttacgacaggttcattcgaatgcaaaatgcaggatggctccttgggccacttctacataaaagattgtgcaaattaagcacaccctccccattttctttttttggctggttacaactatcggaagtggcattgacaattcttctatggtcccaagtaattaatgaactctatagtgggcggatacgtatacggcggggtttgcagttttttaacttcttgttatttgagctatttcgacttttacttgaaagaattaaattagagagtctgaacgaggagtgaagcacgcgctccatgtgaatccatttagttcaaactgaatatgcgcggactaaaatagttgcactgatggacgtattcaacacaaaaaagagcagtaaacacgtaagttactgctctcctcagtctatccgccgttcatttgttttacaatgtattcagcatcatttcctacaccttgaagcagcgctgaacctcgcctatgctgccaaggcaaaccaataaagtacaatccctccgcagctgaaacaccccggtgatgtataattcggccttccttatccaaaacaccttctattttcatccaccaaagcggattcttaaaaccagttgcccaaataacattgtttacttctaatgaagatgaatctttaaaaatgacttcattttgctttccggctatgactctttgttttaagatgatcttcttctgtcttattgcatgttttaattcatacccaaatatgaggtcgcctttcttttgaatgaacttgcctaatattgatgtatgacttgcatgtaaaactcctaatttatcaaaccaccaaaagatgcttctttttccaatccataaagggaaataaaccggttttttactgcaagccaaatatgtaactctttctttggataactcaacagctatctgagccccgctattcccgccgccgactaccagtacattcccaggcgccagttgttttgaatgtttatattgtgaagaatgtaattgacgaatatgaccggctacatcctttgatattgatggaatgttaggggtatgaaaaggacctgcggccaccaccagattcttcgtttgatattcttcccggtttgttttaattaagaaatagttgtttaatttttggacacttattacttctgtccgtaattggatcgggatttcaaatctttcaacatattttttcagataagcagcaatttcattttttgaagggagtccatgcttgtctccttcaagctgcattcccggcaaagagctgtacattcgagaagtaaataagaccaatgagtcataccggtttttccagctttcccccacttcatgacttttatctaaaatgataaacttttgtttcgacttccttagataatatcctactgagattcctgcctgaccggctccgattactatcgtgtcgtacatatgaatcccccctccggttttatcttaattgtcagcagacaaagttagtccctatctcctcctttaatgatgatgatggtcacgcggattctcagtttgggcctgacaaagaatcgtattgtcgtgattatgcgctgccgtttccatttgaatggttacatgtgtaatgccttgatctccaagttcatgttcaattttgcgtaaaatactttcactttcagaaatggtcagctgatcgttaacaacagcgtggcaggaaagagcattcaatccgcttgtgatagaccatatgtgcaaatcatgaatgctttgaattccttctgtctcttcaattgtatgaatgatgtcagtgacatcgatattttccggagttccttccattaatacgtgaatggagtctttcgtcacatggtaaccgcttctcagcacaagaatagccacaatgacactggccactggatctgcccagctccacccgaagaagatgataaggatcgcagccagtatggcacctacagatccgagcatgtcacttatcacatgtaagtaagctcctctaatgttcaggttattctttgtatctccgccgttcagcataatccaagcgaccaatatattcacagctaacccgatgatacttatcgtcagcatgccggttgttgctatctccggcggatgagagaaacgtttgattgcttcataaatgatataaagggaaatcagtattaatgcaacaccgttgatcacagctgcaagaatttcaaatcgtttgtagccgaatgtcttatgatgacttgcctttttttcggccaatttaaaagcaatcagagcaaccattaatgagattgaatcactcagcatatggcctgcatctgacaaaagcgctaaactattggttaaaaatccgcctatcgcttctattatcatataacctgtaatcatgataaaagagatcaataaaaccttcttattggatccgccagcgtgattgtgattgtgacccataaaaatctcctccttatctaatacactgtatttattatttcttttctgctatgaagcattctaacacggacacaaaaataaccttatatgattatgtgctcatatatgaatatataggttctttactgaaatgtcaaaatattttcaatgaaaatgtttcttatcattagcttagcttgggaggttgcattgctatgaagccgcggattacagtaattactttaggcgcagataatttagaaaaatcgctgcacttctatcgggatggcttgggtctgcctacagaatacagaaggaacagccggtacagatttggacgacttgcaaacgggactgaaacttgccctctgggaccgcaaagacatcgcacatgaatcaaacgttacgataactgctcccgctcatgatactttttggggcggatacgccggtcacttccaagattccgacgggcacttgtgggaaattgtttggaatccgcactgggaatataagtgaataaccaacttttatagcaacaataaaaacacacctgaatgttctggtgtgttttttattttgtttcccacaacgatcaaactatttatacgatggcgggatgctttgcggaaaacggaatacattttcgggatcgtatttcgcctttattctttgaagccttgcaaagtttgagccgtaatatgcttttccgaagttctcgatattttgatccggaacattcacataagaacctgttacatatggtttcatcagctgacgcactctttcaactgatgcaagattcgaagcttcttgtgatttatttttccaactggccgtccattccgtataaaataacggacggcgccaatagaaggctgtttcactgcttggaactctgcttatcgcaccgccccaattgataaaaaagaaattggtttctgtcccagtcgctttttctaaaaattgtctcattactgcaataggttcttccggccaaagattgagcgcccacgccgaggagaatttaacactctgatcagacctgccgggaatcggttcatcaggatctaagaaatctatacaatccggatagtatagtgttttgattactgtttgtgccggcgttccggcatttaataaaggttttaataattgaatcagctccggttttgacccgaggaacaatccttccgcatggcacaaaccatttactttgctgtaaatctcaaggtagcatcctaatcgttcgtctgtaaacggtgcccatttttgccatgctttgaataccgtttctaactgttcccacggccaaataatattaaagacggttgcggttttaggggcacggtgaactttgaacgtatattgggtgttatatccgaaattgcctcctccgccgcctctggaagcccacagtaaatcttcattgcgggaatgatttgcttgaatgatcctgcctttggcatctaccattttcagtgcgagaaggttatcacttatcaggccgatcgatcgtgaaagcactccaaatccgcctcccatcgtgattcctccgattccgacggttggactgtctccgaacggggccataaaaccttcccgagctaaaccttttacaagcgggccgacgtgaatgccggtttgaacggttgccaccgcgtttttttcatctaagaaaacgttattcatgtcactcacatcaataacaatcccatcacttaccgtggaaagatttttatccagagcatggcggccgcttctgacacgcaaaggcacattcttctcacgagcccatttaatagcattacttacatcgtatgaattttgcgcaaaaacaaagacaagcggacagacatcaacataagggttccaattcttaaccgcctctgtatagccggggtcccctttgaagatgacacgtcccgttaactgtgctgatcccatctatttcactcccaataagcatttgattcccataccagtatatgtaggaattggacaaattcttagacagatgttctgcaaacttaaaaatagatacatatacgcgaagatgagaaaaaacaaaaaaaagacaagtgcggcaacctgccgaaactcttgtctctcctgccatgataggcacttacatttattggcgtgatatcccgaccaaactatggaagtccatagaacattatgtttgccctgccatgcgtggttctgctgagcaatctttctgtttgatcccccgacaagaatctttttctttatcgtttttgcacccctgtacggataaaatcaatacacattgaatcttatcttttacatgatgaaaagctcttattttttcttcttgtgcttacgtttgcaatcatgttttttctctttcttatgacgttttttacatttcgcttttgctttggctgctaattttgccgcttctacctttgcttcagctgctgcttttgctgcttctgccgctctggctcttgcttcttccgctcttgctatggcttcttccgctctggctctcgcttctgcttctcttgccgcttccgctcttgcatcgtcgtccgccatatcaaaatcatggccaaggtcacaggcctcgttgtatggctttttcttctggaagtactgttgatcgtcaccatcgttataatacattacgccactccttctctcattttttaatctctacatactatgtaaagaaagatctgcagcttggactggtattttgatgaaccggcacatttttagggcaattttcatttatcattgcaacagaatctggatgcctgcatgaaacttgaatgattttgacgattatcttaagcagcgtaaaaagggagactacgaaaaaaccaaggggttaaacccttggtttttttgtaaaaatgataaaaaggatgctgcacgctgcagcatccttctgtaccaactttttattgaacgattggaaagtattttttagcttttagtttgcttgctgtgtttgttttactggttctttgctaaaaagtccgacaatgttccacaagataatagcagcagctatgattacacgagccgtactgacttcttgattagtaaacaatttatagccatatattgatcccaatgctgctatgcaaaaaatattgaaccatttactccaacgcaattagaaaactccttataaaagattacatttccaaacaatatattataatattaacaaattttttcaatatttaaccttaaattattcttaagtggttttcctgatcattttctctaatcgtcattcgatctttcggagttttgatcgtttttttgttacaggctagacccagacatcattttcagctgtttgatcagttatttcctgcccggtattgacaacacctttaggttctgcaagcaaaatgttacactctgattctgcataaggtttatgttcaacatttttcggaatgacaaacatttcaccttcatttaattttacttttccatcacgaaattcaatgattaaattacccttaataacaataaagacttcatctgtttcgtcatgcttatgccaaacaaaatccccttgtactttaacaagtttaaaattgataatcattcatttcagcgattacttttggagaccattgatcttggaatgcagataatttctcttggaaattaatcggtttatattccattctttccccttcccgtgtaaaactcaatcatttaactagtcccaaattaaaggcctgtcaacctcagcagttctgaggtagtctaaaagctgaccggtatgtacagactcatggtaagcgattcttaataacatgtctcccagttcgcgaatatatccaacatcagacctgtcaatctttatatttgttaaatctgtttcgtttaacgatttgatgaatgtcaaaaacgcggcccgatacggttttgcaaattctaattcttcgcttactgtggtaaacgtttttgattcataaggattaatagtttcctctgaaaactcactcatatttttcattaaaatttgatgataaagaaattccgcttctaatacatgtcttatcatttccttgcacgacatggcttcggagtccgggcgccagtccattttttcctcaggtacagctgtccataacttgatgcttcgccgtcttacctcttcaaaatgtaaaacaataaggtcaattgtattcaagtattttcccccttttatttttaaataataattctccttcttcccggaaaaaacctcttcaaataaaaaacatatcctttcccgactcgccggattgataatcaaactatttttaagataaggagatattcattcatccatacaatagactctggctgaacatatactgaatgatagttttcatcagaaaggagaaatcagctttggcaaaatatcggatcatgacctttgacgggggcggtaccttaggtgctttaagtttacaactattgaacagactggctgaagaaaatccggcattaataagccgaacccatgtatttgcgggaaattcaatcggttcatttactgccctggcattagcaagcggaagatctccgaaggaaacacttcagtattttgaggatgaaatcctgcccgcattcagcacttcccggccgggcggacctgtttttaatcagcaattaccctattccggttttattaaagcggtacgaaactttttcccgccaggccttcgtcttaaagatgtaagaaaacgaattgttgtcccttcattcaaattatactccccggcactggatcgttggacgcccgtattatttcacaactttcccggctctccctatttaaatgagaaagtgagtgatgtcatactgcggagcagcggtgctcccgcgacacagcgcgcctatcaaaactacgtggacggatatgtagtggcaacgaaccccagtacggccagtatcgcgtttgcggttggtaaagccaacgtgccattggatcaaattgcggcgctatccatcggtacaggtgaagccccgactcggttaagaagagatacgaggggatggggaatggtaagtgcggataacatacgtcccgaaaatctgaagaaccttcctccaaattggggagtccttttggacaggtcgcctaatgaacctttactgccatttcttcagatgatctccggcggaaatggctactatgaatccatggtcagcgcgaatctgctgggagatcgctttttccggttagatccgcggattcctaacttctccaaaacagacccttccgtggttcccgctgtcattgaaattgcaaacaaaaccaacttacagcctgcgaatacatttatagagaaaaactggaacgacagcgctaaataagcaagaagtttacatcatcatacaatgaacaaaaaataccaagggactcaaacccttggtatttttaatgcgttcaatcgggccatttattgaatagaactgccccagaagtcgcttcccattacgtaaagaaagcgacttttagatttgattttcaagttccttttacaaattttgaaaaggccattgactattcagttgtactgtattaagtttaactatatagtcgaactgaatagaggatgaggatatgaaacataaattattaccgctgtctgaaaccatgcattatattttattagctctgcgtgagccgcttcatggctatgccgccatgcagaagatagaaaagatgagtaacggaactgttattttagcagccggcacattatacggcgcgattgaaaatttgaataagcatggctggattgagcctgttggagaatcaggccggagaaaggtttatatgataactgcggaaggaagcgccattttgaagatggaacaaaacaggttactgcatattttatccctgcacgaaggaagtgaatcgaatgaagaaatttaagatgttttttgatattgaaaaagaggagcaatggctgaacgagcaactacaaaaaggctatcgctgtacaaatatcagcggattaggaatatacactttcgaaaaaaccgacaaaaaatatgtgatgagactggattatcaagattgtttatcaaagaaaaaatttaaagagtacaaagaaatctatgaagacttcggctgggtttatataaacagcccatggcttagcggaactcggtattggcaaaaagaaaatgatgatcaaaatgaaatcttttcggatcgccaatcaaagagtaattattataaaagactaatggggttttcatcttgttttggtttactgtgcttgttttattcttatttgatttacaaggattcgggtttatatttaactgaaggtctgtggagtatggaaagcgcaatgttttggaaagcatttttatttgaaactccatttgccctgttgaggtcgcttcccgcccttatggctgttctatttggctgcagtttctataaaacgtatcgaaagtattcaatgttaaaagaacaataacacggggaagttacattcaaagaagtaattgaggatcatgcatctgccgaagccgggcgctttaaaggaaaaaaagcgccctgaatttgctgataaatcagatgacttattttgttaatgatacatacttatttacaatggcttgagcgagacaggctgatgaatcaacaatagtaagtccgcttcttttttggtccgtgaccatatttaaatccgtacatgcaatgataaccgtatcagccttttctgctaagtcatggtgtaattcatcatataatgtaccagcctcatcgatttgaccttgtttaattttttctattatttgatcgacatagatttgccaactatcttgatgtaaaaaatcataaccttctctgtttaacgcttcttgaaatattccggattgaaccgtaggaacggtggctaaaagagctgctttttttgagcctttaggtattttttttatggtttcatcaatcatgttcagtaaagggactgaaatcgatttttttatttgattaaaatagagatgtgcggtattacatgggatggcaataaaatcaacacccgttttttcaagctttacagcacccttaataattgcattttccatgtccgtatgattgagaggtttattcatgtagaaaggtgtcggacaggaataaatcatcatatgtggaaaatccgtgtcatgtattgctccatatattttttggcactcgtctacgactttatctacaaatggcccagtagattttggccccattcctgccagtattccaatcataattgtcctcctctgtaaaaatgtgtacgaatacgatcacgatgagttattcttgtgtttctcatctgaatctgctctcatttcttttctggctttcttctcctattttatcatttcattaattgaaaaagggctttaaaaaagatagctggcaaaccagacgacttgctttaagtaacggcgcagccgcaaacaaaaaataccaaaaacctcagaacccttggtatcattgtgatgcggctgagaggacttgaacctcaatgggttattcacccgctgggccatcaataaagtgaaactgtgttttctattacaaaacctttatatattagtgtgtgtttatattgatcatgttattttacaaagattaattcatattgtggagtaaaaatggagtcgtttttttcatcaccagaaagttacatgacatgtcttgggtgccatgtttgttaaaatcaccatcttcgttttaaaacgtacaggtttatagtgttccaaaacgctgtcctaaatgcaaaaaaatactggacgcaactaagtcaaatgtttttcacggtactatagtcaagacttgcccaagtcaccattatcaaaaagaattaataagaaaccaacgggtgatgaatcttttaatctttcattttacccgctgactcatatcaaaggagctttaaccaaattttaatagctgtcgcacttattaatagcgctaaaatccattgcaggaattttgtatttgctttttgcccaacagatgcgccaataggagaagcaatcaaactggcaatcataagaaccagagccggtgtaaaaagaacctggcccgtgattacttttccaactgttgcgccaatagatgaaagaaatgtaatcgcaagagatgaagcgactgtgattctaacagggatatttaaaatcgataacataatgggaaccaggataaaggcgccgccagctcctaaaatacctgatacgccgccaatgagaaacgctagggacgaagccaaccatttattagatatcacttcttcgtcttcgctatgttcttgtccttttttaggtataaacattaaaataactgctagtatagccagaattccgtatataaagttaattcctttttcagatatataatgagaaaagtaactccccaatacactccctaaaaggatgctgcttcccatgtacataattaatgctttatttaaaaaaccacttttacgataagcccaaacacccccaagtgtcgcaaagaaaacttgaatagcccctatccctgaaacttcatgggcagttaatgacatcactcccactaaagaaggaatgtataatagcattggataattaataactgatccgccaatacccatcattccggaaataaaggcaccaataaaccctataatgaaaagagttgtgataaaagcaatatccattttggttcctcctttcaaagaaaaagggcatctttgtattcgataccctttcacattcattagctttttttaatccagaattttaatacatcgccttcatcagtttgctctaaaagatcatgcccgcctgatttagaccaagctgcaagatcatttttagctcccttatctgttgcatgcacttctaatatttgacctgattccagttcattcatcgctttctttgttctgacgattggcattgggcatgccagaccttttgcgtctaatactttatctgatttcatgttcatctctcctctttttaatagaaacttgagttaccgtattgcacagcggtttggaccaatctccatttcacgctgtttttcttcatctgggctgattttccccatgtttgtttctcgaatctcttggtatgcatttggctgcggaggcaaatgatctgttactaagtgtctgaattctgtttcatccgcaatgttcaaaccatggttctcgctaaataatgtacttagttttttaccaacacttccatccttatttagctcgtcaatgatcataaagtgtgccggtaatacaattaaatcctgtgacaacgctttgtaacggctataaagcgttgttcttaaatctcctgcccaatcttctgccataccggctaagtctggtctgccaattgaatcaataaacaagatatcacctgaaagaagatactgatcatcgacaatgaaagaagtggaaccaatcgtgtgccccggagaataaatcggttgaattttaatctttgtatttccgatggtcatgtcgtttccttcttccaacggctgataatcgaataccgcttcttcagcatctttaggcggtaaccagtaggctgcttttgttttttcagcaatgactctgccgcctgaaatatggtccgcgtgaagatgtgtatcaaatacgtgagtaatcgtcgcactcttctccttcgcaaaatccataaagaaatctaccatacgcgtcgcatcaataatcgccgcttcaccattggaaatgaccatgtatgataggcagcctttaccgattcgaacaaactgatacatctcaccgccatcttttaaatccccgacttttaccggctctaaatgttcgctccatgctttcattccgcccttaagataggatacagaatgacctgcttcagaaagcatttcggataccatgacagatgaaccttcttttgcacaaacgaccagcacatctttatcagaaggaattttctccaagatatcttctacgccatctaaaagatcgaaatacggtacatttaaatggttaaaatcatgtccttcaatcttccaatcgctaaagtcattttcattacgtacatccaaaataaataaaggttctttgtgaaagattttttgtgtgacttcttttgcggtaagtgcttgcacggtcatgtttacatacctcctttttctgttttacctgtccagtcccgcataccgggaataacattaataacctttttaaaaccttgttttttcatggtgtgagctgccatttcacttcttcttcctgaatggcaaataatataaatttcatcatttttgtttaattcgttaaagcgcttttccacttcgccaagagggatatgcaccgctccggggatatgagcttcttcatactcctctatctctcgtacatctaaaatgtgaagagactcatcacgatccactttctgtgtgaaagcttctaatgaaatctcaggaattgaagatgcattttctgatgaatgctctcctccttttcgaagaaagtgacgaaggacttctccctctgtttcagtacctagatattcatggcctgagctttttgcccatgcttgcagatctgccgccgatcctttatctgttgcttgaatttctaataggtcaccagcttttaattcttttattttcttctttgtttttacgataggcattgggcatgacaaacctttagcgtctaatacaatatttgctttcacggtttttttcctccttttcttatataggggcgggggtatataaatatgcaaaaagttattccctggatgttaataccatgtattcataccgccttttatatttgtgatgtttttaaacccttgtttcttcaatattttacttgcctttacacttctcattccgctttgacagatcacaaagacgtctttgtctttcgaaagttgatgagtttgacgaggcaagatagacaaaggaatatttttgaatcctttaatatgccttgtacggaactcataagaagttcgcacatctataaactgtttgtctttgttttccgcctccgattttaaatcagcagttgttatttgtttaacaccatgcaatgggaaaaaacgtcgaaatacgatccaaagtattgaacattactccgctattcatagtgttatatccccccttcacttattcaattgcaatggatcacattagataaataagttgacattgccttcctcagcgtctgccaaataagcagctacaccagcatagtcgatatcatctaatagttctttttcctgtaaaccaagaagatccattgtcatcgtacaagctacgagctttacaccttgttcttgagccatctcaatcaactgaggcaacgtaagtgcattatgctttttcatcacatttttaatcattttagggcccatacctgcaaagttcattttagataaacccatcttatcggcaccgcgaggcatcatctttccaaacattttttcaagaaatccttttttcactggaatcagctcttctttacgtaaagcgtttaatccccaaaaagtatggaagatcgtcacttcatgatcgtaggcagcagcaccatttgcaataatataggctgccattgctttatcatattccccgctaaataaaacaattgttgtgcgttttgtttgttttgtcatgtttattctcctgaccaatcactattacccctgggggtatattgaaattaaaaattttttcgaaagatctcctattattcaattcaacatattaaataccggtaggggtatattataatgaatataaaaattcgtcaaccttaaagatgataggttgatgaatttttttatcggctctttaccaataagtcgaccgcttcttttactaagtgttgtgtgtcttctcccttttctaaactttcacgaacacaatgttcaaggtttgtgctcacaatcaaacccattgctcgatcgatcgcattacgtgaagcagctaattgggtcacaacctctctgcaatcttttccttgttccatcatggtcaatacaccttttatctgtccttctatccggcgtaagcgatttttaatcttttgatcatattccatgcgttgaactccttctttgaaatttatatatttgcatgttatccactatcatttcatactgcgctttatcacactacattattaactagataatgtttgtgaatcaatattatacccttacaggtatactgtcaattttcaagacggcatgagaatgattttaaagagttaatattagtatcccctgtttaatcacaagaaggcgctgaagttgtacgtgatttaatgcgtatgaagaaagagaaagcacttaattcaagcgaaaaaaatgttggataatgcatatgaatttttgattagtgaactggaagtcattaaaggaatcactgaaaaacaaataaaaagtttctgttaaggttaatgacagataagtttttcagagtattacgatcagacgttcaacttcttcaacttactttttaaacattaaccgcttttattactcctcaatctaatctgttatatttttttcttcaacgaacacttgaattctcgatgaaatagtcacttgatttttgtaatcctgattcaccctggcacggacaaggagccgtaacgatggaagagaggcagggctttcattgttttaggtctaagtgattatttccggaagaaaaaacaaccactctcccctttatctttcagaatttcttacatctcttgcgacagtgaatagcagttgtttatcttatttcataaaaaagatatgcgaattgtaacaaagaataacataccgttaccttgagaacataaaaacaaatcatttatatattccacatatcgtcaatccggtatgttatactgtaaacaatcctttgaggttttaaacctttttcttaccttgtagcatctgtccctactcgaacggtgagtagggttttttattcagtatgatacagagaacataaaaaaacaggccctatataaagagcctgtttgtataaacgattgaagattaagcagttttttgaacgttagcagcttgagctccacgagcaccttgctcaacgtcaaacgttactttttgaccttcgtctaaagatttgaatccgtcactttggattgcagaaaagtgtacgaatacatcgtctccattttcacgttcgataaatccaaaacctttttctgcattaaaccatttaactgtaccttgttccatttttgttgcctcctagtgtattacacattgtattactatccttgcccaaagtatcatcaagacgaaaagtcgatattcatactatcctttacacgaacaaaaataattctcctttatcatagcacgaaacggaaataactgcaaattaatatcatgtttcattcagggttttatttgttaaacgtgcggcaggtttttttgcgagaaccttcatttggaaattagaagttttgacggaccccttaccgtactaaataataaatatcatgttgagaggtgtatttttaaaaagcccactcacgaaaacgagtgggtttacaaaagctctaactaacccgcaaaggttttagtcagagctatttattttttgatccaactcactaagcgcctactctgtcatcagctcgataatattcattggaacgtgataaatcccctttttcataaaaataatcagctactctgattgcaaagttttcaatgtctccgtacattcttaggaggaagataccattagcgatgacgctaatggcgccctttgtttctactcagtaacttattcagcttctcccacaactgtaaagcgttcatttatatgttttggattttctatttcatccaatactgcaattgcatagtctgcatagctgatataactttcgcctttcgagttcacaagaagatgatcttttcctgactgataaaacccagttcttttcccgtctgggtcaaataccgctgaaggactgataaatgtccagtttatatcagaagtttcctttagctcttgcaagttacgaccttgccctttagctgttggaataaaaatctccgggaaatcaggtgtatccattacactgacagttttattttcgtctacataaagactccctgctccgcctacaattactgctcttgtacctattccttttaatgccctaattaatgcccggccagcatctacatgtgcctgttcttctcctaatggagctccgaaggcattaactattacatctaacttttttagatcatccgatgtaagatcaattatatttttttcaatgattgaaaccttttcctctttaagttttgcagcatctcttacaattgcagttacctcatggcccctgcttaccgcttctttcaagataagacttccagcttttccggttgcaccaatgattccaattttcaatttaaagtcctcctaatcattcaaaattttaaatgtaaccaaattgattacatgtaataattttagttacaccttatttgtttgtcaatacttttatcaccttgttaattgagcatattagagtgaaataaacttgtaatacattcagttacaagtgtactataaagagtgtaaagtaattaggatggtgaagaaatcatgtctattagcagccgttttgctgtaggaattcatatattggctcttattgaaataaatgaagacggaattagcacttctgaatttttagctggaagtgtaaatacaaatcccgccttaataagaaaaattatggggatgctgaaaaaagcaggtttagtaaatgtacggccaggtattgcaggagctgaattagcgaaggatttaactgaaatcaccttacttgatgtttatagagcagttaatgttgttcaagataaagaattgtttagtatacatgaaaatcccaatcctcaatgtcctgtaggccggaacatacaaagtacaattggtccaatatttgaaatcgcccaatctgccttggaaaaagctcttggacatataacaattgaggatgtggtaaaggatattatcgaaaaagaaaaaacggccgataattgttaaatgattcacagaaaatcttttatcagactggggataagaaaaatcaataaaacaaaaagggactggatcatattgaatccagccccgaattgatattgattttagatttagattacggtaagggatataaaaatgctcatgataaagagaaaaaattaacgacaatgcacacgatgccagattctttaatagggcgtgagtattactatccaacaactcaaggttcagaagctaagttcaaacaaagacttgaggaaatctcggattggtataaaagaaaccgcaaatcttagtttgaacgaatatgttctgtatataaaaataatgaggtatggagtgaattgataatgaattatgatgaaataaaagattactgcctaacctttccaaactcttatgaagaccacccttttggagatggttggactgcaattcggcacaaagggaataagaaaatatttgcacttatcttcactcgcgacgaacacttatgtgtcaaccttaaatgcgaacctgaaagggctgattttctgcgtggtctttttgaagaaatcaagcccggataccatatgaacaaggagcattggaatacgcttaccttagatgagggactcccagagcatcaaatccatgacatggtaaagtacagctttgaactgacaaaaccaaaaagtaaaaaggaaacataacatcgaaggatagaacgctcattatagatattcatccggtgcaatgatacagaggaatatgcaaaaaacctcaaggtagcaatttttaaattcgtatttacgagatgattttttcgttattgtgagtcctttgtttctcgacataggttgaacaaataaaaaaagagcagactcaaaatccactcaattaattaagatgattgctcatttcatccagacacctataaaaaatgaaaggtgacgatgatatgccgcaaaggtcatttagcgtttaattaatactgataactcaccttcaaacactttttcctctttctgattataggtagataacaatacagtaagtatccccgtctggcttttatttggttttttatcaataaccttaacaatagtgttcagtttatcattagggtaaacgggtgctaggaattttatattattcattcctgtcccagcaataatatcgtcttcatgacacccttcttcaatccaaagcttaaaagtaatagataacgtttgtattccagaagcaataattccattaaacctgcccatttttgctttttcttcatttaaatgcatgtactgtggatcatacacttctgcaaaattcattatattctcttttgttaattcaaaagatttagtttgaaaaacctgcccgatggtaaattcatccaacttcataaataaatctccttgaatctaaactttattattaaatctacgtagcattttaacatactggctctcacacaacaacttaacggtaaaacaattgttcccctatcaggaatgaacaagcacattgtttttgtttccttgcctttaacctctttataatcaggtgttttcttataaagaccaaggcggtcgccatcaccatcacccggcatatgtgccatttcctcataagaatctccaagcttctcataataagaataagcagtcagcctacgagaactttcttctggctgataaaacgctgaatatacttgccgtcatcatatacagaaattatggcgttatctcttttgtactcatctgaatctgctcgcatttcttttctgactttcttctcctgcttcatcacttcattaattgcattatcatatttactaccgccgcacgcagtcagcagaaggatgaaggtgactgacaaatcatacgacctactataagtaagtggacagtaacagatgaatttttataaacaaaaaataccaagggtgtcaaaacccttggtatcatagggatcggccgagaggacttgaacctccgcaggttattcacccgcttggcccgccatctatattcataaaactattgctcagttgtcagcatgtgaagtaaattacgaatttccttgttataacttttaatttcttcttcattacaaccggttttatcaaatactgcattaggtatcattgtgactttttctttaaactcattcccttcagttgttaacgtaataattacacttcgttcatcctcttttgaacgctctcttataataagacctcgctcctcaagtcgttttaaaactggagttaatgttccggagtccagatataattcttcgcctaaacctttaacagatattttttccttctcccataaaacaagaagaaccaagtactgtggatacgtaattcctaattcttttaagagaggatggtataactttatcatttcacgggaagctgcataaatcgcaaaacatagatgattacttaacagtaatttatcattcttcatgttaaattcctcacaatatttatattcattactacacataatagcataagaattacattaagggaaattgaatgactgacaatttaattaaccataacttatatacatggaaactttatttataaccaaaatgtgtttgaggtgcattcttattatgaccgatatagatacttccactatattgtttagaccgactcatagatttattgagccaccttctcaatatggttattatgtacactaactttaaactgcggaaaactgttctttattttagtctaatcattcatttagagaattttaattgcgaatttaaattgagagcaatttaatttcaaaaaatttaattgacaacgctgattagattgattaaaattcaattgtgttaaatttaatttataggagtgtttgatgatgacagtatattttacagcagaagctacaacaaaaggcggaagagaaggtcatgtaacatctaatgatcttattattgatttggatttagctatgccaaaaccaaatcaagtatccgcggctacaaatccagaacaattatttgcggcaggctattcagcttgttatgacagtgctcttcatttagcagcccagagacaacgattaaaaatcgaatcagctgttaccggtaaagtaagtttattaaaagatgaaagtgataatggttataaaatcggagttgttctggaggtggaaattcaaggggtatctcaagagcaagcggaagaattaacacatgcagctcatcaagtatgtccatattctaaagctactcgcggaaatattgatgtacaaatcattacaacagcaatgtaagacgaaagatgccaagatcaataggtaatagaataaaaaaatttgattaaaacatataggtgaccagccttcaaataaggagtgagattgatgttaaagaaagtacaattagaaaaagcagctcaagaatttgcagaagcaaccgcgaacccaccctatctattcgaccttggacctgagaaaggacgagaagctgtagatgaggttcaatctgccccaattgataaactgccagttgatattgaagatgttatgatttcaggaggaccgagcggacaggtatcagtaagaataatgcgcccgcagaatgcgcctgcgcaccttcctgtcatcgtgtacattcatggggccggctgggtatttggtaatgagcatacacatgatcggctcatccgtgagctagcagtcggagcacaagctgctattgtctttccaaattacaccttatctccagaagcaaaatatccgacagccattgaagaaatctatgcagtagtgaagtgggcatctgaaaatggccgtgagaacggcatgattcccgagagtctaacaattgcaggtgatagtgttggaggcaatatggctgctgctgtcacgctaatggccaaagcacgaggtgacttgaatatccggcaacaattacttttctatccggtaacagacgcttctttcgatacggaatcctatcaccagtttgctgcaggatactttttacgcaaggacgcgatgatgtggttttgggatcagtacacaaccaattcgaacgagcgtgctgaaattacagcatcacctctgcgtgcaactgctgagcagcttcaagggcttccatctgcattgattatcacagctgaagctgatgtacttcgtgacgagggagaagcatatgccaataaacttcgtgaagctggtgtttcggtcactgccgtacgtttccaagctatcattcacgatttcgtgatgctcaacgccttagctaaaactgaagctgcgcgcggagcaattgatctcgccgcaacctggctgcgtaaagggttttaatccatttattgtttcgtcacatagagactgctgcaaataaataaaaaacaaacagatccactcaaataattgagtggatcgtatattggaataatggaacttttgatgagctttttaatcgggctggttattattttgttgttgagatgtccctaattgaaaagctaactccacaacaaactccgttttttcaccagttcaccctcttcatatccaaaaaacctttgttgattagttagcgtacaagttctcgttttctgctttggaccccatacagaaaataaaaagccagctctccttcgggagaagaactggcataacaaagcttcttgcttcttattttgctgtattgcccggaccttttaatttctcttcgttcttgcgtcaatgttttattattaggacacaaccaataaaataatgacgatcgagaatagcaacgctgcatttgcaaagcagtaagccctccagaatataaaagagctgcagtcattgctgctcggataatcccagcttattctgagtctgtatttcgagtagtcggtcaattaaatggatgtttttttcattccttttctgtttgttccattttccaccacagtgaatcttttggattttcaacagcttcttgaaactcagctttagaagcaactgttgggtaagaaccttttaaagatttacctgaagtatctttaaataaggttaacacaactattaagccaattaaactgactgccaataaatagaaacccggcgccaaattgtttcttgtcacatgggttaaccaagaagcaactaaaggtgttgttccgccaaaaatagaaactgataagttgaatgtccaggataatgtacgatatctaatgtcagtatggaacaacgtaggtaaagatcctggcatagtaccttcgtatacagataatacaatacctaacattaaaagtcctataaataagaatgttatattccccatattaagaaattgaaaagagataattgaaaatacaattcctaatactaatccaattgttataacttttttatttcctaatttatctcccagtttaccaaaagttaaagcgaacggtaccataataatcaatacaattgctgtaaccggtgtacttatattatcacttataccaaggttctcatctaaataagaaggcatataccctaataataggtaattggttatattgaaaaatgccacaaatacgatacataaaaagatatcttttttatatgttttaatgacttctaataaacctggttgttgttcttggttttcagagatgtcactttcaaagattggtgattcatctagatgacttctcaaatataaaccaaataatcctattggaatacttaagaagaaaggaattctccatccccaactattcatttgaacatcagataaagtccagaaaagtactgtaactaaaacagaagctactatataaccagataatgtgccgatttctaaaccgctgcctaaccttatacgtttattatctggagaagattctgcgatatataccattgccccagcgtactctccacccacagaaaagccttgcagaatacgggcaaagagtaataatataggggcccataccccaatctgatcataggtaggaagcacaccaattattaaagtagataaagccatcattaaaatagtaattgttaatactattttccgaccaaatttatcacccattttaccaaaaataattccgcctaccggtctaagtaagaaggcaattgcaaatgtagcaaaagtaaatattaactttaattcatcgttttgaactggactgaaaaagtttttactaataataactgccaaataagaatataaagcaaaatcaaaccattccatcgcgtttcctatccctgtagcaaacacgcttttcttcgctttttgaatgtctacaacgttaatttttttcttgttaaacttcatttaataatatcgactccttaattatcaaatccacattatacaagcgcgtaaacggtccgagcatgcagtcccagaatgtatagcgtaatgcttctctaaaagtccgggggtttctgtttcacctgatggagagctaacggcatagtggctgattggttcaactgtaccttaaaagactagactaatatccatatcagcgccaaataacattgtaaaccaggaaagaaggatgaaattaagtgttttcgctggtttccttaacttatttttgccgattgggctaaaaataatacaagaagcaacaaaaagagaaacagccaacagataataccagcctaagcggttagtgagatatccttgggttgtggttggtattttctgcagacgatttggagaaatgattccccttcatacagctctattgtgaatatgatcacaatcgaaaaaaaacttttatttcttcaaagtagcctaaacctttattttagatcttccattacgtcttccaatatgtttattataagattgaggtcgttcctaagaattatttactgattctatctttattaccccacaatcaggtgaaacaaaacactataaacgtagcatacctttttaaaacctgacaagcccaacggggtgatagaaaccaggctaaagccaagctagtcaatggatagaagaaatttttttgtttttcccaaggaataaccgtctgcgtttaatctagcccaattagaaagaaaaagagcaggagtaatcctgctctttcattcaaaactttaatttgtatgacgaatttcgtataccttttcaactttctttaccttagactacaacagaaataagtagcacagggtatgaaataatggttttatttaaacagtcaatcaccgacaattgaatttattgcatgacacctgacaaaatttttttatccagctggaaataaagtaacattttttaaggtaatggatttatttttgttcaatgattaaatgatccccaatgacaataaagactaataattactaaaatttcaggaaaccccaatattgcttatcttaattattgtttaactaattggtaattgcaacagtaaacttatacttatggaaagttataccaaccgaaaattttccgactcaagtctgtttaaccagttgtgaaccaatgaattaaatacatcggtttgttcgatttgcaggttgtgaccagccatatcaagtactgcaaaagttgcccttgggtaatcttcgagtagccgccacgcatcatggtatccgactacattgtcctgacgccctgtgataattagcgtgggataatcaagtttagatgaaatatcgaaggtaaacccatatccattttgacgaatgttgtttacgaattcataatttgtttgtttagatggaagtaaaatttcatcccgaaacctctcccattcagttttaccttgcacaatccccatagagcaaaattcattcgcctcctctgaagacaaatgtgatatcaagtcgctgtctctttttagaacagtcttctgcggtactaccctttcatcgaattcgggtatagttaatggtgccatcagcagtaatccacgaactgtttccttacgtgaacgaacgatacctctggcaatgtaccctccatatgaattaccgcaaacaataaactgttgatcaggaataatctcgtccaaaagacgcaatatcgcttctaaaacatcatcagagttctgaatagatggttgtggcttagaatgtcccatacctggtaagtctatgtatattctcttccaaccgcttcgtttctcgaataacggttccattgcatttaacatcacctgatggtcaagtgtccaaccatgcaacataacgatcggatatccatctccaattactttatggtaaatcgacatgtagttgttccccttccctgtaatcctaatgtttcgacatgaacatttaatcctttcatacatttatcacaattttaacaaacttttaactgaacttggtaagttgaacaagggttatacattgaatttcgacaatcgcaaactgtcatatgtgtccgtcatatcaaaagaatctgtttaatgtgttgtttagtgctttcgttactgcgactatcgacaaataagaaccaagcaaagtattgtccagatactttgagtattttgatcactttgaactttaggtaagtgggcagtttgtgggcagtagatcatttaaaaataagcgcaaaaaaataccaaggatctctctattacccttggtatcattgggatgcggcgagaggacttgaaccttcacgggttattcacccgctgggccctcaacctagtaaaaacctatcatgagtttcaaaagcttttattcaaagcatctgtttattttatttatacttattttcatcatttttcatgaattccgagcacaaactgggcacctattagagaccaaggaaatctacatttcaacaagaaatatctactcatcgccctgctgtaattagtttatttcagcttccctcgcgaataccggatcaatgctcagctttaagatagtcaaccaatttctccgcactgttcttaacatcttcttttgaaaggtgaagtgtaccatattgtgcaaaggcaggaagaaaacgcattcctatatagttagcagtgatttgaaacggtctgataagctcgctgatcgtgatattatattctccgcctgcttgataatcagattcctgtgcgcctaaggagatagctaagagtagttctttgccatgcaatttagtacctccagttccataagcccaaccatgtgttaacacatcatcttcccattgtttgagtaacgcgggactgctgtaccaatacattgggaactgaaaaacgatgcgctcatgatctaacaggagctgctgctctttttctacatcaatgataaaattaggatattcaccgtacaggtcatgaaccgtaatgtcattctcttgctttaaacgattcatccaggttttgttgacaacagacgtttccaaattagggtgtataacgataactaatgttttcatttgactgattatcctttcttcgccgattagttattattgcttttacgataatgaattgaattaattttaaaatatcaactttatttacacctattttatcctttttcgtgaattcagggcaaataattgggcaccgattacatttatagccaaaaaaagacttaaccttttaaaaaagattaagccttttcagtacctttatgcccctaccctattatctcgtgtctaaattctaatagctgataatataacaaggcctctttgttttcctccatgcttagcaatactttctctgccttttgcaaattggagtttgaggcattagtaactacctataatgatgaaaatatttgtgcgacgtcaactgtagatgacttactccaggtaagtgggcagtttgtggatagtagatcatttaaaaataagcacaaaaaataccaaaggcggttaaacccttggtattattgggatgcggccgagaggacttgaacctccacgggttattcacccactaggccctcaacctagcgcgtctgccattccgccacgaccgcgtgctatgaagctgtctttccactaagcatataagctagtgatgatgatcagcactttgaaaagaaagtgcgggtgaagggactcgaacccccacgtcgtaagacactagatcctaagtctagcgcgtctgccaattccgccacacccgcgtgacaagtggtgagccatgaaggactcgaaccttcgaccctctgattaaaagtcagatgctctaccaactgagctaatggctcgctctaaaagtgattcaaaatttttaaataaaatggctgggctagctggattcgaaccaacgcatgacggagtcaaagtccgttgccttaccgcttggctatagcccaacgaaggtaaatggtgacccgtacgggattcgaacccgtgttaccgccgtgaaagggcggtgtcttaaccgcttgaccaacgggccgtctggttgagaacttatctggcggagaaggagggatttgaaccctcgcgccgcttacgcgacctacacccttagcaggggcgcctcttcagccacttgagtacttctccataatggctccacaggcaggattcgaacctgcgaccgatcggttaacagccgatagctctaccactgagctactgtggaatgatcagactttctttattataaatgatgcgacatattgtgtcaataagcaacatttattttttttgagaaagcatcgttgtctctcaacgacttttataatttaacacagatcattgaaatgagtcaagcctttttaaaaaattcttttgatttttcctctgcactttccgcaggcatatctttccgggttcattgcccgcttctttatatactgttggccgcaggcctcgcatctatacatatatgttttcttttgtgtctttttggtttgcagcggcgtgcagaatcttggcgctccgactttctgaagcaggtctctgaaatccttgtctctgtgcttgtacccttttccctcaagatgaagatgataatggcacagctcgtgcttgatgatgcctaccagctcgctccgtccgtgttcgagcagatattttcggtttaattcgatgttatgggaagacagcatgtaccggccgcctgtcgttttcagccggtcattgaaaaaggcccggtgacggaacggctttccgaaatcctgtgcagagatgtcttccgtcagcttttgaagttgttcgttatccatatgtgcaccccgctttaaaaacattgaacgggacaattcaccgttcgcatacaatgtgttaaaaccgacctctaactaaaagctgaggaggaatgagccatgccgaattggctgatgaaacaaatgcaaaaagcgtttttagaaaaggacaattaccaaatcaaactgctgaaccagtgctggtatttctacagaaaaaaacactgctcgtaagcagtgcttttattttaccatagacagcgacactctgcctttttgcacgtccaccccttcgacccatacggtgacgatgtctccgaccgatacgacgtcgagaggatgtttgacgaattgattgctcagttttgagatgtgcacaagcccgtcctgcttgacgccgatatcgacgaaagcgccgaagtccacaacgttccggacggtgccctgcaattccattccttcctttaaatcctcaagctgcagaacgtcttttttcagcaaaggcttcggcacttcgtcacggggatctcgctccggccttgtcagctgcccgcaaatatccgcaagcgtaatctcccctataccgagctcctcagccgtttcagacagcggcagtgcgctgattttctcttttacgtccgcgcttccgatctgatccgcagtgagctgcagttttttgagcagcgcctttgtctctttatagctttccgggtgtatcccggtgcggtcgagcggctcccgtcctccgggcactctcaaaaagccgatgcactgttcatatgtttttgcgccgagacgcgggatatctttcagctctttgcggtttgtaaattttccgagctcttccctttttttgacgatattgccggcaacggttttggataacccggctacatattgaagcagcgcggctgatgctgtattgacattcaccccgacttggttgacgacggtctctacgacaaaacggagagattcgtttaaatgcttttggctgacatcatgctggtattgcccgacaccgacggatttaggatcaattttcacaagctcggccagcggatcctgcaacctccgcgcgatggagacggcgctgcgctcttcgacctgaaaatccggaaattcctcacgggcgatttctgacgcggaatacacgcttgctccggcctcattgacgatgacataataaatgtcccgctctgtttctttcagcacatcaacgacgaattgctctgtctcccgtgatgccgtgccgtttccgatcgccacaacctcgacttcgtaccgatccagcaattctttgattttttttcgggcttccgctgtctttttgacgggagcgtgcgggtaaatgacatcgattttcagcacttttcccgtctcatcaacgactgccagtttgcaccccgtgcggaaggccggatcgacgccgagcacgacttttcccttcatcggcggctgcagcaggagcttacgcaggttttcagcgaaaatatggatcgcctgcgcgtctgctttttctgacagttctttgcggatatcgcgttcaatagccggctggatcaggcgtttataactgtcctcaatggcttctttcagcgtttctttcacaggtgtttcacggtgtttgatgatttgcttttctaaataagcttttatctgatcggcgggcggttcgatcgcaatctttaaaatgccttctttttcaccgcggttcatcgcaagcactctgtgaggaacgaccttttggatcggctcttcgtactcgtagtacatctcatagacgtttttctcgtcatctgcggctgacttgcctgccgcggaagtgagaattccttttttatacgtttcctggcggatccactttctgaaatgaggatcatccgagatttgttcggctatgatgtgcttcgcgccttcaatggcttcctctcttgaagcgacttctttttctgcactgatatattgatcagcgacgtcgtgaaggcggttttctttcgggagagaaagaatatagtccgcaagcggttcaaggcctttgcttttggcgacggtggcttttgttttccgtttttgtttgaaggggcggtataaatcctcgacttcctgaagcttgaccgcttgctcgattttttgcttcagcccgtctgtcagcttgtcctgctcggagatcaatctgatgacttcttctttccgctgcgtcaggttttgtatgtattgccaccgctcggagattgcctgaatctgcacctcgtccattgagccggtctgctcttttcggtaccgcgcaataaacgggacggtattgccgtcttccagcaggcggatgacactttcgacatgtttttgggataacgctgtttcttcagcaatttgttttttcaaaagggctaacgtttccatatcacaaaagcctccatctcttctttctttctctagtgtatcaaaaaacggcggaacataaaaaaagcagccttacgataaaagctgcccgagaatataggtcaaatcatcacgtctggatgttgtgtacggatgaagtgattttgatatttcttctattgagtgtccctgctttaagcaggtgcggatatgcggaacctcaagcccatccgtgtagatgatgaatgtcgcccctttttcgtatgatgacgtatacgttttgtatctttgcggtttgcctgagaggtaacccgaaatcggcagcggatgaaaaacttcgcctgatggggagtgcaggaagaaacggacgttgccgatcgagcagtatgtcaattcccttttgatgaaattgatttttaagatggaggcagtcgcccctcttttgtttttcatcgcttgattgcagcgctcaatgatgctttccacatcctcatccgcatacgtttccacgatgtctttaatggctgacgaggattcattggcaagagatccgctgccgagaccgtccgctaccgcgcaaactaattcttcttcattcgccttcataaaaaagctgtcgccgcatatggacttgccttctttatttaattggtatacaagagtttgaacatgttcattttcttcaacctgaatcattacattagctccatggagggatctccaatcaaggcctctctcagttttttcaccgctttccgctgcaggcgcgagacgtgcatttgagatattccgagaatgtcccctgtttctttttggcttttattttgcacaaatgttagatcgataatctgtttttcgcggtcggacagcacatgaagcacgcttttgatcatcatctgctggttgacgcgttcgtatccttcctcctgcgacccgacgatatctaaaattgtgacggtgcttccgtccgcatccgcttcgatgctgtgatcgacagaaagcgcctgatagctttttcccatctccatcgtttcaagcacttcctcttctgacacatcgagaaaggctgcgatttcttcgactttcggcgaccgctgcgtctctgtcgtcagctgatccaccgccattttaatgcgcggcccgagttctttaatccgtctcgggacgtgtacgctccatgttttatctctgaggaagcgtttgatctcgccgatgatggtcggaatcgcaaatgcttcaaaggatttgccgacctcgggatcataccgtttaatggctccgagaagtccgatcatcccgacttggcggagatcttcgtgaaagctttttccttttgaatatttctttgccagcatttcgacgagattggtatacacctcgacgagtgtttcctgggcttctttattatcatgtgtttgaaagtcgcgtatgagccgatcaacttcatctttagttagtttcgtagtttttgatggttgtgccatgatcaactcgctccccatttaaatactttgtcatcgccacggttacgccagagttgctttgaactttgacttcatccatgagcgtttccattaaatacagaccgagccctccttctgacaattgatcgactgtgtgcgaaggtgtgtacggcccgagatcctgctgcttctgatcaaaatcaaagctgtctccctgatcggcgacaatgacctccagccgatcctcaaacacaccgaaccgcacggatacttctcccttattttcatctttgtatgcatgctggacagcgtttgtacaagcttcgctgacagcgatttttaaatcttcaatgtcatcataggtatagcccattctgctggcgactcctgataatgtaagcctgacgattcctacatattccggttcggccggaattttcatctctatataatcaactgatgtactcattgcacgccaccttctgactttgccgaaatgtcgatgatgtccttaagccccgtaatttcaaacagacggacgagccggtcggaaagattctcaagcttcagagagccgccttccttgctcaccgttttaaacacgcctacaaaaacacctaaacccgtactgtccatatagtttacatcttttaagcagattctcatgtccttcccctcgtttgccaggggcatcagcttttcacgaaccaccggagctgagtatacatcgatttctccagcgatattgatttgtatatctgaaagattctccttcatatctaccgttaaattcatcgtatcacctctgaaagttatccttactcgtgctaatggctttttacccgtgctgccgtttttttaaacctttcttttcaaaacaattaacgtaaaatcatcatgaagctgaaagtcctgaagtctcagcaggctgtcgtaaatatttttgaccatatcctgcgcggagcagtccatatgttcttccagcatgcgctgaatgtcgctgcgttctaagaaaccgttttcggtacggcattcggtgacgccgtcagaaaaaagaacgatcatgtctccttcgtccatgtgctgttcatattggctgtaatcaaaatcctgggaaattcccagcaccaatccttttgcctccagatcataaaactttttttctttttcagagtagtagaagcccggttcatgccccgcagaagcatatgtaaattggtgatttttcgtattgtagtttgcgtaaaacatggtgataaacatgcttgagtccacgttctgttctacaacgcggttaagatttttcagcacttgggaggggtgaatgccgatctccggaagagagtccatggcatacttgatcatcgacatgcacaatgcggcgggtattccttttccgatgacatcggctatcgcgatgttaatcgattccttgtctttgacaaagtgataatagtccccgctcatttgcttggcggggacgctgatcgccccgatatccagttcttcttcttcaggaatttttgtgcccagcagcgtctgctgaacatttgcggcaatttcaatttctgaacgaagctcctgctggatatctctcagactttggtgttcctgataagccatcccgtagccaatcatgacttctattaaaaaatccagcgaatgaaaaacatcttccggcagatccggatacagttcctttaccacttttcggtggatgctgatgatctcctccggaggaacctgatgttcaatcgtttttcggctgaatttttgggcttgatataaagatgtttctgttaattcggctatatatcggctaagcagctgatgataccgctgctctataacctccctgaaatccacgttctaacctcctaccgaagccattttacggcttgaatctctgttccttcctctgcaacagattgcaggctgaattcgtccatcagccttttcacgcccggaagtcccgctcccagtccgcctgacgttgaaaagccgtcttccatcactttacggatgtcggggattccgggtcctttgtcttctgctataattttaaggccttttttccctctgtcgtttacttgttctatgctgacctggcccttgcctgcatataagtaaatgtttctggccaattctgagatagccgtcgtgattctggcctggtccaccgtgccgaagcctaattccttcgcaacgttgcggccaagctgtctggcggctacgatatcccattctgtcatgattttcacacaggattggtcgttcatcgctattcccccaattcccgcttcaatgtctcaagcccttgctctaaatcgagcgccgtttcaatttcctcaagtgagattccgagttcaatcaatgtgaccgccacagccggctgaattcccgtcaatacgacctttgcgcccatcaatttagacatggtgatgacatcgccgagcactttcgcgataaatgaatcaatcatgtcaacggatgtcaggtcaatgacgaccccgtttgcgccggtttcatagattttgttcagcagatcttcttgaaaatgcaaagctgtctggtcgtcaagctcccattggatggataccaataagcagttatacagtttcaggatcgggatttttggatgtctcacaatgttattcccccaatgaaacgatttttcgatttgtcatttcaagcgctgtttgaattcctttttgaagggtattcttcgtaataacctgcgacaaatcaattcccagattaacgatcgtctgcgcgatttccggacggattccgacgagcagacatttcgcgccgacaagccgcaccgcttctgatgcctgaataatatggtgcgccaccatcgtatcaacgaccggcacgcccgtgatatcaattaatacaacctgtgaacggtgctttacgacgccgtttaacagattttccataatatgctttgcacgctccgtatcaatcgtcccgacaagcggcatgaccgttacatgctcaaataccgggatcagcggagccgacaattcctgaagcgcgattttttgcaaagtaaccgttttttcccaggagatagaatactgatttaagatttccgtgttgatcggattgaaaaagctgtctatttccaaaatcaaatctgctctgtcctgatcggccatattaaggtcgaccatcgtttcgtaaagcagtttccaaaactctgacagggtggctgaaagaagtttcagcgacaggccgagctgaacggcgcgcagtgcgagttcactgatctgctcttcggcagcctcgtcattttttgtcgataataaaagaatgtctatataatctttacaaatattttcacatatgtgattcgtaagctgatagtcttcctgattgcctacttcttttagtttggctgtccaagtatcaagcagttcatcatgctgatcaataatgaactgatacactttctgattcgacatgggtttcactgacctcccgacacaaaacaacaaattttgtttgattatttctttattatagcgcttatgtttttcgaaaacaaaaaaagttgctctatatgagcaaccaaaatatgactaaaaatcaatgagtgccaaactgatttgcagggcttcatcaaccttatccatcatttcatcatccagatgagttattttatccgttaatctttgcttgtcaatcgtccgaatttgctccagcaaaataacggaatctctttcaaaaccgtagcgttttgcatcaatttcgacgtgggttggtaatttcgctttctgtatttgggctgttatggctgcaacaatagcagtcgggctaaagcgatttccgatatcattctggatcactaaaaccgggcgtacgccgccttgctctgagccaacaacaggagataaatcagcaaaataaacatcgccgcgctttacaatcaaaatgattatcctccgctgactaagcgctcaacggtcgtttctgcttcgcactcagcatagtgagcctcagaagagatattcaagttgattttcgccatttccatatacccgcgtctcatcaaatcacggttatggcgagttgtccgttcgctgacatacgctctcactgcttgtgatatcagttcgtttctgcttcgtttctcccgcatcgctacaccatccaattcagctactaagttttcgggcaagctgattttcatttcggttcttgcgctggattcagacaaaaaacatacacctccaccaaacttacggatacgaccaattcatccatccagacataatgataccattattcaaacgtcaagcaaagctgttttataaattctctttttccggatgacggctacttgtttgtattatcttgcagtaaaggatttcttacttccattatactctcattttccaaaaacatacggggaacgcgggaactaatggtacaagggacctcgtaattaatcgtctcaagccgccctgcgatttcatccatcgtgatcgtttcttccttctggctgccgatcagggtgactttggtgcccggcggataagattgatctaattcgaccatcaattgatccatgcagattcttcccgcgatgttcatccgtttgccgccgatcagcacagacgtgccgctcagcttgcggagccacccgtctgcatagccgatgggaaccgttccgatccattgatccttctctgccgtatatgttgcgccgtagctgacgctttcccctttgcggatctttttcacatgggataacacagagtgcagcgcaaaagccggctttaattgaaacggaatttcgctttggatgtcagcagaaggacgaagcccgtacatactgatgccgaaacgaaccgcgttaaagaagccttttttaaggcgaagtccggcggcgctgttcgcgcagtgcaccatcaattcttttaaagggagcggagcgatcaatgttttaaagcggtcaaactggaagaggaaataatctctgtttttctcatccgcggtagcaaagtgggtgaaaacgcctttacagactaaaccgggattttggctgaggatttttaacacgctttggatttcttcctccgttttgactccgagtctgttcatgccggtatcgactttcagatgaaacggcaatgtggcacctccgaggtggcgcgcagcttcctgaagccattcaacagaatatcccgtgagtgttacgtcatattcggcagctgcttgtacatattcgggcggcacggcgccaagcacaagaatcggcgctgtaatgccccgttttctcaatgaaatcgcttcatccagtatggctacggcaagacaagaggcacccgcttcaagcgcggctttcccaacttccaaatctccgtggccgtaagcgttcgcctttacaaccgccatgagatggacgttttgcccgatgtgttttttcatatgcgtgacattttctttaatcgcggacaggttgatttccgcccacgtttctctgtaaaaggatgctgtgttcattcgatacacttcctagcattattttcaattcatattgttattatcatactaaaattattctgcaaagtgaaatggaatcaaaaaagagaccgacagcggcggcctcttttttgacattattttgacgactgtccctgcatgcttttggcggcggccaccatttcatcctttgtcagatcctgtgatgacagaagataatccactccgtcatatgtccacgttaaagacgtatcagataatgcggccaccgtgaagccgagattaaccggttcgcctttcagcgtgacggcagaggcggcttttgcgatatgggctttttcttgaataagggtgaaggatttttctccgccgtaagtcatgacgatccgtttgccgtccgccgttgaaatatctttctcttcaagctttttgacgccggccggcacttgaagcggtgttttgaccgcaaatgaatcagacggcttggcgcttgtggcgacgtccatctgggaaagcgtcatatttttcttctcgtcaaaagagtctttatcaaacggcttgttgaattcaaagcttttgaattcgacttttaccatcactttccggtctgtatccatgactttgacgagcgaagggctcatgtcctttttgttgaaagtgatttcctgagtcggcagcattttgttgtgctgatagtttgtttttgtttcaaacgtgtactttttatctttggcggaatagacggcgtctttgtcatgctgcacgtcctttacaagtgactcaaacaaatatacttggctgctgttattcggccagtcgctttggaacctgaagctcttatttaaagacggcgtaaggacaaagactccgttggcgttccgtaaaatgacttggttttggtcttttttcggattttccagatagacccggtacagggaaggttttttatgccagatttccacattgtatacttgcggatcactccccgtctgaatggtcattttggctttcgctttgtacgaggtgtattctttcgccttcttatctaaaccgttcacgatatcttcctgtgatttttggccgcaggccgaaagaataaggacggcaagcagtcccgttaaaagcaaaacaaagctttttctcaccttttttcaaccccttcttctcaattgatgtaaagggaagaaatcgcttgtttgactttaacggtacgccctgaacggacggacgcgtaccataaaagcctcaaacaacttgtctcccttaatgcactatcaaatatatgaaggggtttcggctaatatgcagactagcgtgacaacctttcaatcacgacctgtgccgcggcgtattcttttgtatgggtaatggagacgtgaaccgccgcgccgtccagcttggcgcaggtcagcaccggcttgcccgccgtgtcgtttccggtttcgatatcctgaaagctgagctctttgccgatacccgttccgtatgctttcgaaaaggcttcttttgccgcaaatcttcccgcgagaaattcaattttccttttgtccgacagcaatgtaaaacgggcgtattcagcctccgtcaatattctttgcggaaacctcgcctgccggctgagcatgttttcaattctgtgcagttcaacgatgtcgattccgattccgaaaatcatgtgaattcctcctaaaagtccgtactaaaaaacggtttatgtcataaacgtgttactatatatgtaacaaatcagatgcaaaggggcttgcgatgtttatacgtacggaaaatttccagacttttatcagacgttatccggccgtcagctgtatcttggcgctgcaggcgttcttgtggctgtttttcagtatgccgcttcattccgtcatgatgtggtcagatgcagtgaccggctataattacggcgtttcctcgggagaatggtggcggctggtgacaccgatgtttttacatgcgaatttcactcaccttttgtttaactccatgtctctctttttattcgcgcccccgctggagcagatgctcggaaaagtccgttttttgattgtgtacatcgcatcgggcattatcggcaatatcggcacatatcttgccgaaccgcttgattatgtgcatgtcggcgcatccggcgcgattttcggacttttcggcgtgtatgtgtttctgactgttttccgcaaggagctgatcggccgggaccagtcgaaaatgattatgaccctgcttatcatcgcggtactgtcgacgtttatcaattctaatattaacattatggcgcatttgttcggactggcaggcggatttttgctttcctttttatgcgtgcagcaaaaaaagcggcggtattaaccgtccgctttttcatatgaataccagcgcccgatgcgttcggcatcttcctcgctgacatccttcagcatgacatgctccatgtggtgagctgatttcactgcggtagccacagatgcgagccgccttcttttttgcagaaaggagcggctgacttcaaacatctgcattcttcttctcagcataatcgtggtcgtcttcccgatcagccgtgtggtgagctgcagccggcctccgtttaagcaccatgacgcgctcttaaatgaggcgtagcccagcaccagttcgacgggaagcacaaggagcgatgcatacccccacggtttaaacagaatacaaagcggaatgatcacgaaaaccgagaagataacggagcggaataaataccggcgcagcgcccttttcggcaaatgattcctattttcttccagtacgtaatccggtgtgaaaccgttcagcatcacaccgagctttgatttgcggatgatcggaaacagaatcgtctgagctccttctttctcattccccgcactgccggcgctgacaatcgcaaccgtcgcgtatccgaataactgcctgatcacattttctttaattttaatggcttggattttacggagcgggatggtcacttgatgtttttcaataattcctctcgtaatgaccaattcgtgttcctttttttctatcttaaagttggcatgcttgatcatcataccggcgatgcttaacagccaggcgatgaacaatcctataaaaatgatcacggcgtatatgccgatgctcgcatgcttgagaaaagaaaacctgtcgtagaaccagtccatcggaagtacttcatcaagctgagaaaagagggcgaataccgctgagatgatgacaccgatccccccggatgttgaggcggccataagcagctcacccacagacaggcggtaaacggattgcacatcttccccgcgcatcggctcctgctccgctgcggtctcccctcgttcttcttgctccgctttttgctgaaaaacagccgctctgatccgttccgcctcttccacagtaatggcggataagacggcctcggcgtttttcccgtcgccggccgtttcgatttgaagcttaacaagcttaaaaagctgctgaacgatgccggcactcgtattcattgattgaatccggtcaatggagatgtatctctttttcgtaaaaaacaagccttcttcaattctgaattctccgtcctcaatccggtatgtaaattttctccactcgatcacacttgccgtaatcagccagataagcaggacagcgagcgcaatgcctccgtaaaagcggatgaagtggttggaattaacaatatagacgagaaaaaatggcagaataatgtttttaatggtttcgataataatatggaataagttcaaaatcacggccgccgggtgcagacgtttcggttcagacatcatcttccgtcacccttgccagacgggaaatggaatccctcagccggtcagcttcctccatatcaagcgccggaatggaatgaacggttgccgccgtagagattttgactgaggccaggcggtaccttctgaggagcgggccttgtgaagtatctacgtgctgcaccctcaccatcggcacaatgacccgtttgactataaaaatgccggattgaatatcaatttcattttcatggacctcatagcgccagatcctgtgcctgattttcggtatggcatagacggatatcactgaaccgatgacccaaatgatgccgaggactccggtgatccaatacggccaatggaagaaatggcttaaaacagctgctgctataacggccagaagacagaaggcggacaggatgatttcctgaagacgccagacttttaagccgcttggactgattcgattttttggctgtgctctcaacatacctacctcccattttttatcatacatacaaatacggctgatttgcaaaaaagattcactttccggcatatcgaaaaaaagcggaccccgaaaaagggtccgcttcctgtgttttagtatgattttttctggcgtctgtcacctgaagaacggcggtcgcttgagcgttttttatcgtaggaagaacggttgttgtttttccctttgccgccgcggtagccgccgccttggccgtctctgcgcttagaagtacgctggtttttatagcgtttgctgaccatcggcgcttcatcagtgaggcgtacaggcgtgctgtccggctcttttgtcgccattttaatggctgcagccacaactgtcactgcatcatgatcttctaacaattccgcagctgccgtcatgtagaagttcaggttgttttcgctgatcgccgtgcgcagacggtcaaccgtcacctgctgctgaccttctaatgcttcgtcaagcgtcggctctttcatgcggtccattttgcgttttgtcgtttgttcgatcgcgcgaagcatgtttttctcacgcggtgtgataaacgtcatcgccatacccgtttttcctgcgcgtcccgttcttccgatacggtgaacgtaactttcaggatcttgaggcacgtcaaagttgtatacgtgggtaacacctgagatatcaagtccgcgggcagcaacgtcagtcgctacaagcacttcgatcgcaccttctttaaacttgcggagcgctaccatacgcttcgcctgcgttaagtcgccgtgaattccttcagccgcatatccgcgaaggttcagcgcttccgtcaattcgtcaacacggcgttttgtacggccgaatacaatcgcaagttccggagactgaatgtcaagaagacgagtcagcgtatcgaattttttgcgctcctgcacttccaagtagaactgctgaatgttggacacagtcatttctttcgcttttacttttacgtgttccggctcagtcatgaaacgctctgcgatccgtttgatcggcgcaggcattgttgctgagaataagagcgtttggtggtcgctcggcacgtttgagagaatggattcaatatcatcaatgaatcccatgttcagcatttcatcagcctcgtccatgacaaccgtgttcacgttgtttaaacggatcgtgcggcggttgatatggtcaagaagacgccccggcgtacctacaatgatatgcgggtttttcttcaatgcgcggatctgacgtccgatatcctgaccgccgtaaataggcagcactttcgcacgcttatcttgtccgattttatataactcttcagatacttgaatggctaattcacgggttggcgcgattacgattgcttgaatattaggagactcggggttcattttttcaacaaggggtataccgaacgcagctgttttacctgtacctgtttgcgcttgtccgatgacatctttatttaaaagtccgagcggaatcgtttgtgcctgaatcggtgttgcttcttcaaatcccatacgattgattgatttcatgagatcagaacttaattggaaatcttgaaacgttatagtcaaattattcaaactccttctgattgctgtttcagtaatgtcgtgatttaccactaaaaactgccctttcatccaaaggacaggatcatacgtatacaaagcccgaattactttacgtttaatcttaccattacactatgtgtttttcaataaggcgagatggtcaggcggccggaagcggcctgaccggattcttcccgcaaacgaggccggaccccgcgccggacgggatttcccagccggcggcctttctttttcatacggacagaattatttcaccctgaattagtttcttcatttttgtatatttttataatgctgatcagtattttttcagttcttctctaataaatctttaacgatttcttcgagcttcatacctctcgatgctttaaacagaaggagatcgccggaagcggccatatcctgtatggcgtgaagcagttcttttttgtcgagataatggctgacgcgcccttcttcaaaatgccggcgcgctccgtctgcgatgaatgcgccgagtgtgccgtaagtaaatacatggtcaatttccgccggattgatcgcagctccgcattcttcgtggaatgctttttcttcatcaccgagttcaagcatatcaccgagcacgagcattttcttccgatagcctttcatcgtttcgattaattcgaccgccgctttcattgacgtcgggctcgcattatacgcgtcgtttacgatcgagatgccgttttccgttttaaccagttccaatctcatccccgtcaccttcaggcggctcagtcccagagcggcattttccggcgtaatgccgaaatagatgccggcggcgtatgcggccatggcattcatcacattatgtctgccgagaaccggaataaagaaagaacgttcgatcccgtcgatattgaagtacgtgccttcttccgcctgttttatttctttcaggcggagatcattgacagcgcctgcgccgtatgtcgttgtccggcaagtgtacgccttttcgcggagcaacggctcatccccgaaataaaacagaacgccgtcttcccgaagtccgtttataatttcaagtttcgcctccgcaattccttctcttgagcctaaatcctgcatgtgggattcgccgatattggtaatgacggcagcttccggttcagcaagacggctcagaaaatcaatttcgcctctcgcgctcattcccatttctaaaacggcgatttctgtatcttcaggcatggcaagcacggtcagcggcaggccgatatggttgttgaaattgccggcggttttgtgaacacggtactgagtgctgagaacggcgtgaagcatgtctttcgttgtcgtttttccgttgctcccggtcaccccgatgacccgtgtgccgagttctttcaaataagctttcgccaatgtctgcagcgcctccagcgtgtcatcgacaaggatgacggcacgctcttccggcggattcggttcagagcggtcccacaacaccgcggaaacgcctttttcgaatgcttgcggcacaaaggtatggccgttaaaatgctcgccttttaaaggaatgaacagctgatttttttccaaagtccgcgtatcggttgcggcgccctcaatcattgtttgttcaaatacaggatttgtcagtgtgcctttgaccatgtcggcgattcgttttacagttcgctttatcaaaggtggcacctcgctttctgaaaatgttgtctgttacgggaaaagacactgccccttcaggcagtgtccgtcttcattaaaatgtatgtttaatcagctgtttttcggcatggcgttcttttgccagctcaaccagctgttcgatcagatcactgtaatctacgcctgcttctttccaaagcagcgggaacatgctgaatggcgtaaagcccggcattgtgttcacttcgttaatgagcacttgaccgtcattggtcaggaagaaatcggcgcggacaaggcctgatccgtcaatcgctttgaaggctttaatcgccatctcgctgatttccgcatattgttcatccgtcacttgcgcgggaatcattaaatccgtgtcgccgtcttcatatttcgctttgtaatcgtaaaagtcggttttcggcgtgatttcaccgacggcggaacatttcggttcgtcatttccgagtacgccgatttcgatttctctgccggcgattccttcttccaccacaattttccggtcatactcaaaagccagttcgaaggctttttcaagctcttcgcgatttcggcatttgctgattccgacgcttgacccgaggttcgccggtttgacgaagcacggatatcccagctcctcttcaacctgctgtaagcagctgtccggcgtctgtttccagtccttttttaagaaagcggcgtacttcgcctgcggaagccccgcttgagcgaacaaatgcttcatgatgactttatccatgccggctgatgatgcaagcactccgttgccgacataaggaacgttcagcaattccagcagtccctgaatggtgccgtcttcaccgttcggtccgtgcagaagcggaaatacgacatcgatctgcgccttttcgtcaggcgacgcttcaggaaacatttcccggttcaatgctgatagagcgaaactttcaccgttttgttccagctgaagcattttcacgttggaaaccggctcagtcagcagcgggcctctttgccattctcctttttcagtgatgtaaatcggatgtatatcaaacttctcagtattaagcgcttttgttacagctaatgctgtctgcagcgatacattgtgttcggctgactttccgccgtacaccaatcctagacttgttttcaatggatattccccccacaacaattcatctttactatcttatcactttcctcagaaaatgatctaattatttttgggcattctgaatatgaaagcatttgtatgtaattcctttttattttatattaaaatggcatggaaaaggagatgtgtcatatgaaaaaaatcagtacaacagaacaatttaatgaacttattcaatccgacaaggaaatcatcgtgaaatttttcgctgattggtgccctgactgcacgcgcatgaatatgttcatcggcgatattttggaagaatataatcaaaatgattggtatgagctgaacagagacgagctccctgagcttgccgacaaatatcaggtaatgggcataccgagccttctgatctttaaaaacggcgaaaagaaagcgcatcttcacagcgcaaacgcgaaaacgcccgaagaagtcacagagtttttatcacagcatatttaattcgtttcacgatctttgtttatgacttcaggctctacatgaacatggacatgagtcacatcatgttcatgttttattgcatattcgacttcatcggctacttcatggccttctttcacagacagtcccggatctaccgtaatgaccatttccacatgaaccgtgctccccaaataccttgctttcacatccttcagcctgctgacctcttttatttctttcactgtgtgtttatacggctccaaatctttcagatcaaacccgtccgttaatgagtgggaagcatctttgaagatgtcccatgccgtcttacagatgataattccgatcagaaaagcaatgaccggatcaatccacggcagatgaagccgggccgttaagacgcctatcaacgccccaatactgacataggcgtcagaacggctgtctttcgccgccgcatgaagcgcagaacttttaacccgatccgcaagacggctgttatatacatacatgccgtacatgacaatcgcgcttcctagcgccgtccatgccgcaatgaagctcggctcggcctccgttccgctgacaatcgcctttgctcctccgatcagcacttcaataccgaccgccatcataataaaagacgcaattaatgaagaaattgtttcagcccgataatgtccgtaggcatgatcactgtccgcggggcgctgggaaatccggagcccgatcagcacagccagtgatgcgacaatatccgtagcattatttaacccgtccgcactgagcgcttcggaatgataaataagaccgatcaccagtttgacggcggcaaggataaggtacgcggcgatattaagaatcgcgcctttttcgccccgttttaagtttgccgtttgatcattcatgtaaggactcctccattctcattcatagtatggatggaaaagcggaaaaatagcagctttgatctgaccaaatgcaatattcgacagcattattccccgggaaactatttgtcgaaaaattggcggtatttttcctttacatatgaatatgtccattgtataatttcattaactgataatgattctcaatatcaattgattaggagggtaatcatgaggtcttctcctcagctcagatcatcagttgaaggacgaaaaaaacatctgatccatttgctgatcaataacggaatatacaaaaagtcggaacggcatttatatgaattatcgctcggagaattagaaagcgaatacaaatatgtaaggaaggtgcgggctcatggcgaaacgtaaaataaaaacatacgaacagctgataaaagaaaacaaggcggccattatgaataatcaaaagctgatgaatgtgatctatgacagaattgaccgcaagcatcaaaaactgctccggcacaacagccatacataaaaagagcctttttcaggctcttttttttattgctcaaaggcttccgccgctaatttgccgatgaccgcatcgtccatcggcggattgtgaaggccggcccgggcatcccgataataccgctgaagcggattatttcgctccaggctttttgcgccggtgattctcattgctttgtcaacaacagaaaggacggcatttgtcacaatatgttttgccgcgccgagctcgcttttgatgaaagggcggcgtttcggatcatcatacatttgcgccgccgtgaagagaaactgtctcgcttttaacaattcaagctccatttccccgacacgctgctgaacggccggcacgtctttaatcggtccgttcaggctgttcggcgaatattcagatgcaaaccggacggcatagtcccttgccgcttgagcgatgcccagataagcagcgggaatgtgaagcagccagccattcactttcgccgctctcggcccgctgataagctccacaagccgctcgtcactgaccgtgacatgatctaaaaggagatcatggcttccggtcgccttcatggcaatcatatcccatgtttcttcgactgaaacgcctgcctgatctttatgaatgagaaaaacaccggtcgtttgtttttcttcaatccatgccgtcacaagcatataatccaaagtcagtgaaagggttgtaaaggtttttcggccgttcagcacccattttccgtcttttttgacagcggaagtgccgggtcttcctcccctcgtcggactgccggtctgccgttccgtcgctgccctgttcaggacggctccctttttcacctcttttgtgataaatgaaaagacaccttcatcccagctgtttccttctccgagctcacccatgacggataaatgccagccgattccgagagcgacggccgcgtctccccgcgccagccgttcctgaaacagcaccatctcataaacggaaatgcctgcaccgccgaatgcctcaggtaccgttaacgccgtatatcccgcgtcgcgcagtctttgaattttctccgcgggaaaacggcccgcctcatcatcaagcgcggctgttttttgaaattcgtctgcaagcaggccgattttttccatccattcccgctgccgttcattctgtatccataaagacactggaatccccccattataattccgataaagttaataagtattatagagattcaagtctcgtttcgcaactgtgaggctgtacaaaaaaacgcgctattccatagaatagcgcgttcagactgcttccgggccgcggtcctgcttgagcccgagataaatcagcatatatgtgagataacccatcgtcatcacaagcccgccaaagaaaaagcttgaaaaaatcggctcttcaaacgcggtaaccgccgcaagcacgatccagcttgcatacaggtagatgatgaaataacggaatcccgtcttcattttatataagagaaacagccccactgtagaaaacaaacccagcgcaagcctgaaataaacaagatgttcgaattgaaacatgaatgacacaaaggaaaaaccaagcaataacacaatcggtaatgcggtaataaaatttctcaagtgagcacctccgtcattacctttattataaatcaaaatagcataaattattgatttatcgtgatctttttcacaaaaatgtcattcctttactttatacccgaatatcgcgtttgcaaaagctccaccaagcgacggctaagaagaatacgatatggataatgataatgcctgcggaaaataacggcgtcattcccgcaaacagcggcttcgccccgctcatatattgcgtcaggtcagtatttgcgaacagcagaaaactaccccatttgttttggaagagcgacataatcgtcacaagtgattttgcgccgtacagcacgataaatgacaaaatgacggccgttgcgctgtttcggaatacagaagaacacaacaagccaaagcatgccatcgcaaacgcctcgacccagttcgtgccgattactttcagggtgttcacaagaagcgtccctgattcagatgtcaccgacactccgaagaaagccatgccgaacagcagagacagaatatagtacgccgcatacaggtacaagctgaccaaaaatacggtaatgagtttagatacaaaaatccgctcccgctttaccgggcggattaacaaaaatttgatcgttttcttatcaaattcagcggaaatgatcgttgccgcgatcacgatcgttaatgcctcaagcagaatattcagcccgggggcgtacgccatatagccgatgaaattctcatccgttccggaactgatgacaagccgtttaatgacaagcgccataataaattggagaacggccatcagaatcagcgccactaatgagacttttcggttaaagagtttcatatgctcattcgctgtcaatttaaacattcgtcttcccctcctcttgaagcgccgtcgtcactttcatgaattcatcctccagcgattccgcatacggcatgatggaatacacgagaaagtcttgtccgacgagcgcacggtttaatgccgggatgtccttcttcgctacggtgacggtaatgctcccgccgtttttctccggaacgaattgctgctgggacagccattcgaaggcttcgtcagccggctgaatgtcgaggatggctttttcttctttttccgcagcgccgcgcagaacaacctctgttttgatctcacctttttgaatgatgatgacacggtcgcaaaggtcctccacttcacgcaataaatgcgtcgcaaaaaggatgctcgtcccttcaagctccgcgagttcctttaagtgatcgcggaaatccttcattccgccgggatcaagcccgtttgtcggttcatctaaaatgagcagattcggacggtgaagaatggcctgtgcaatcccgagacgctgacgcatgccaagggaatacgttttaactttgtcatgaacggcatttgtgagcccgacccgctcgatgacttcctgaagcctgtcttctgtgatgtttttgtgcatgttggcaaagtgcttcagattttcccaccccgtcaggtacgggtagaattcaggattttccacgatcgctccgacggattcaagcgctttttcgaaatcagcatcgtgctgaaagccgttaattgtaatcgtgccgctgtttttctttaaaaggccgacgatgattcggataagtgtggtttttcccgacccgttcggaccgagcaaaccgatgatctcgccctgcctgacatccatgctgatgttttttaaaatgtgctttttgcctattgttttgtcaaggccttcaatatgtaaaatcggctcagtcatacagccttcctcctttttcacaaaaaataaacagtgcccgtacataggcactgtctgcattataacattagtcatatattcgtgaagagccggagccgtcgttatgtcttatccgggaccggtccgtttttttccttctcctcattattgacgacatccagaatatcaagcaggaacacaaaaatcggaattccgataatcaagccccaaatgccgaagaaatgttctgagaaaatcagaaccgtaaaggtaaaaaagatcggcagttccgtttttgctgacatcagtttcggattaaggaagtacgtctcaatcgcatgaatgacgaaaatgaccagcacgatgtagatgacgtacgcagcgccgcccgtcgtatacgcgatgatgctgagcggaatgagcgaaatcaccacacccgccacgggaatgagcccgaggaaaaagaccatgatggacaggccgaacagctgcggaaaatgcagaatcgccaatgcgatcaaggtgaggatacagttcaccagcgcgataataaattgggcttcaagcactttgccgaatgttctcgcaaatttgctgccgaaataagcaagttcgtagtaaaaaacagacagcttgctgtgctgaaattttttcataaactccgtgagccgctttttctcgaacaggaaaaacatgctgagaatcagtgacatcacgacctgcaaaccgaaagtgctgatatcggccaagtatgtatacagtacattaaaaccttcttttacataggaaccgatattgatatcgccgaacacgctcgatatctcatcataaaacggaatgacatcgggatgatacgcgatgtgcttgatctgcttaatcagctgttcaatctgcttggcaacaatcgggtaaaagacaaagcctccgacagtcgccccgacagccagcgcaatatataaaatggtgatgaccaccctctggctgatccggaaaaaatggttcaacacgtgccggatgacagtctccagccgatccatcagaaaagtaaaaataaacgtaagcaaaatcaaattaatcatacttcggaatacaactaacaccccagtcaaaacaagaaaaacggaaaaacgtctgacacccggatgctgaaaaaatttaaaaatagccgccatttatacactcctgctaggacaaaaagcccttagatttcatctttcactctctaattgtaaattatataacaaaatgacgctaaggtctttgtccacctcctaataaatttaaacaaatttatcttttttactcatggcggccgaaaaaaagaacggcatgccggatgcatgccgttcctttccttttataccgccgtttttatttcttttacggcctgtgtgcttttcgcttcgtcaaactcattttcgctcttggctacgatgatggtggcgattccgtttccgatcaggttgacgatcgcccttccttcactcataaagcggtcaacgccgaggagcagcgccagtccctccagcggaataacctgaagcgccgataaagtggaggcgagcacgataaatccgcttccggttacacccgccgcgccttttgatgtcagcatcagcacgagaatgatcgtaacctgctggccgatggtaagatcaacgccgaacacctgcgccagaaaaaccgtcgccatggacagatagatcgaggtgccgtccaggttaaaagaatatcccgtcggaatgacaaggccgacaaccgatttggaacagccgtaacgttccattttatccatcatccgcggaaggacggactcagaagagcttgtgccgagaacgatgagcagttcatctttaataaaacggagatagttccacaagctgaaaccgaatagtttgcaaatgatattcaaagcgacaaatacaaacaggaacatcgtaacgtatacagacagcatcagactcgccagcggcttgatggaatcaaggccgaagtgcccgatcgtataggccatggccccgaatgcgccgatcggcgccgcgcgcatgatgtagccgatgattttgaaaaaaacgtgcgacagtttatcaaagaaatcaataatgcttttgcctctttcaccgagcgccgccaggccgacaccgaataaaacagaaaagaataagacctgaagaatgtcgccttttgcgaaagcgtcaaccatatttgacggaacgatgtgagtgataaattcaatccagtcaatcccctgtcccccgttttgggtgtactgagagacatcccctttttcaagcttgctgtaatcaaggccctcaccgggtttcatgatattgacgaccagaagcccgataataagggcgatggtggtcacgacttcaaaataaataaatgcttttcccccgactttgccgacttttttcatgtctcccatcttggcgatgccaagcacgatcgtcaggaatatgatcggtgcgataatcatttttaccgcattgataaatgtatcgccgagcggcttcatctgcttcccggcctcaggccaaacgagtccgacaatgacgccgatgatcaccgccgtgatgacctgcaccgtaagatttttgaaaattttcatccctactcccccttgcctctcgatgcgtctatacaaagatgatagcgttttcatacgaagaggggaagcttatgatcataacggacattttggtctttttggtctcggctagcggacgaatttgtagcggttaaccggccgtcccactcccccgtattgaatgtcgagcttaatctggccgtccttctcaagaaaatcaagataacgccgcgccgtcacccttgcgattccgagcgctttggcggcttcttcagctgaaagcggctccgtctgctgtttcatataggtcaaaatttcattcatcgtaaaatggtttaaccccttcggcagatcccgggacggattttgcggaattttcagcagcatgtcaagctgctcttgcgacatcgtgtcatgctcttcaattttccgtttatattgtttatagttttcgagcgcctgtctcatccgctccagcttaaacggcttcaaaatatagtcggccgcaccgttttgcagcataagctggattgtttctttgtcttttgcggccgagacgatgatgacgtccacttcgagcttttgttttctgatttcctggagcgttttaattccgtcttttttcggcatgtatacgtctaataccacgagcccgggccgcagatcttttataagcctgattccctcgtctccgtcagcggccgtggcgatgacgctgaaccctgaaacaccggtgataaattctttattcacctcctgcaccatcggatcatcttcaataagcagcaccttgatgtccatcgaatgattcctcccccttcatcggaaataatatagaaaatgccgttccctgtccctgccgtgtgtcgacttcaatcacgcccatccctttgtcgacgatttgtttgacgaggtacaagccgtatcccgttcctcccgttttattgacggtaaaccctttgtcataaaggcgcgggatatgctgatcggaaatcccgcttccgttgtcttctattaatatagcaagcacttcatcattttgctcgatactgatgtcaatatgtttgtcctccgtgtccgctgtttcgaatgcgccgaacgcattttcaattaaattgccgagcaggacgacgatgtcatgctggtcgacatgctccggaaatgccgagaaactgctgttttcatcaattttcacagaaatgccaagctcttttcctcttttgattttgcttaacagcagccccgccgcggcgtcattctgaatggcctgatgaagaaaatcagtgacgctttcttgttctgatgattccttaaaagcaagccggagcgctttttctgattttccgagctgaatcagccccgcgatggtgtgaagcttgttcatatgttcatgattttggactctgagcgcatcgacaaaatttttcacacctgtcagttcttccgccattttcgccgcttccgtcctgtcctgaaaaatggcgacggctccgatgaccttctttttcatgacaatcggaattctgctgctcatgatcacctttccgctgacttggatttcttcattatatacggctcggttccgctcgacgatttcagggagccgcgaatcttttaacacgtcccagatcagcctgccgtcggtctcttgtctgacattgaatatctgcttcgctttttcattaaaaatggtgatgtgatgctgattatcgatcgcaatgacgccctcattcatcgagtgaaacgtagcggtccgttcctcatacattctcacgatctcatggggctcgagccaaaacatttgttttttgatgtggcgggccagcaaaaaggagccggccagtccgaacccgagcgccagcagaacgataaacagtatttcatgtttcagctgaagaagaatttcaccgaatccgggcagcgttttaccggcaaggacgacgccgatctgattcaaatcccggtctttgatgggataaaaagcgcggacggcggtgccgatctctccctttgcttcggaaaaataaatgtgctcggcgaacgccgcggcttcgtcctcaccccttgaacgctttccgatcattgtgctgacgggatgtgaatagcggatatgatccatatccatgacgacgatgtagtccgcttcattgatgatccttatttcttcgaccgcatggcgcacgtcttccctttgttttttctgctccagggcgcgtttgacatcggtcatctcagataccgtccgcgcggtattcatcagccgttttttcagctcgcgctcctctgtatgctggatattgccgaccagcacgatgccgacgatcaaaaaggtaaaaagcacgacgatataagaaagtatggtgattttccagcggatggtaagcttttttttcgtcattggcctcttcctttccgtctctttacgaaaacggcccgcccgattatgcttgttatagaaaatggcggagggggttttcgatgaaaagcttgctgacttgtctcagcctgatggtactcggtatcggaaccgctttattcatcggctttcatgatcgtttctcaacagaagaaccgtattatgatgacgaacaggaaggcctgaaagatcaaatggttttcaaattcagtcatgtcgtggctgaaaacacacctaaagggcgggcggcgaataaatttgccgacctggtctatcaaaagtccggcggtaccattaaagtagaggtatttccaaacgggagcctctattcagataatgaagaaataaacgccctccaaaacggggacgtgcaattcatcgctccctccacctcaaagctcggatcactgtctcccgaatggggtgttttggatctgccgtacgcgtttacaaactataaagccgtgcaagaaggcctcaacggcaaaatcggcacgcgcctgttcgcttctttagaaaagcatcatttgaaaggactggcgtactggacgaacgggtttaagcagctcacgtcaaataaagggccgatcttctctccggacgatttgaaaggacaggcgctcaggatcatgccgagcagcgtgatcgaagaccagtaccgcctgctcagcgcgcacccgcggcaggattcctttaattccacgtttcagctcttggaaagcaatctcgtagacggagaggaaaatacgatttcaaatatctattctaaaaaattttataatgttcaagattatttgacaatcagcaatcacgggtacctcggttatgccgtgatgaccgacgagcatttctggaattcacagacagaaaaaacgagaaccatcttaacggaggcgatgagagaaacgacggaatggaacgaagcctccgctgagaaaatgaataaagaccagcttgaagagataaagaagaattcatccattcatattcatgtgctgagcaaagcggaaaagaacacatggatgaaacgcctcgacccgatttacggacaatatgaacaggtgatcggccgcgggcttgtgcaggatttgttatccttgcgccgcgagccttagcaggaccaatacgcccatctccgtttcatcccttttcccgccggggaagtaaatagggacagagcaaaaaaggagatggagacatgtttacacatacgaaaaaactgcagcatccggctaaaccggatcgtcctgacccgctgttcgcaaaaaagatgcaggaaattttagggggacaatacggggaaatatccgtcgccatgcaatatttgttccaaggatggaatacacgaggcaatgaaaaatataaggatcttctgatggataccgcgacggaagaaatcggccatgtcgaaatgatcgcgacgatgattgcgagactgttagaagacgccccgctggcagagcaggaaaaagcggctgatgatccggtcatcgggtccattttaggcgggatgaacccgcatcatgccattgtctcaggactcggcgcaatgccggagagcagcacgggcgttccgtggagcgcaggctatatcgtcgcaagcggaaaccttctggcagacttccgcgccaatctgaacgccgaatcacaaggaaggcttcaagtcgcacgcctgtatgaaatgaccgatgataaaggcgtgaaagatatgctcagctttttattggcccgcgataccatgcatcaaaaccaatggcttgcggccattaaagaattagaagaacaggaaggtccgatcgttccttccacattcccgaaggcgctggaaaaacagtcattctcccataagcttattcatttctcagatggagcagaaagcgctgaacaaaattggctgaaggaaacagcgccggacggagaaccatttgaatacgaaaaggaaccgaaagcgcacggcgaaatagctaagctggaccccgtcccgccgtatgtccacaacacgcttcccggacgaaaataaaaaagcctctaaaggggctttttttatgtgcgcacaactgtccagtccggttcgtaccggatgtcggggtgatgtaacagctcgtgaatgacaggttcatccccctcgtacagcatcacttctattgaaagaatcgcagccttctgctcgttttcttcgtatatgcggtcatgttcgttctccataaaatcatcataggcctgtctgtcctcccaaacgctgatgatctctgcgatgaacaggccgtctgcgtttttccgccagccgcctgcctgtctgacgaagccatttacacatgataatgctccccaccttgactgtgcttgcgcaaatgcttcagcgtttgcagcgtctgtttcacatacaatctttttgatcagcatgaccgttcctctgtgatgactgttttcgcatgcgtatgctcgacacagagattcacggttctgacgtaagagcgggtgcggtgaatcgtgcctttcgggatgagcaggctgtcatttgctttgagcactgcggtttctttgtccttaaaatcgatcagcagctcaccttccagaacgatgaaccattcatctgagtcagggtgatggtgccagtcatattctcccgtaaacactgcgaggcgcacacagtggtcattgatctccgcgattgaaaaattgtcgtgtttttctttgactttatggcgatagcgagcaaattcagcatgtcagacacgagtgaaaaacccctttttcattttattgtatcggttttgcggctcagatcaagattttcccaaaatcaaaagcgatccggctgatgtgccggatcgcttttgatctgcaggttgtctgccttttatgcttttattagctgcttcgtctgtttccgcctttttggccgatttctttataaaactctttgtcatgatttttacttgtagcttctccgcctttttggccgatttcctgatagaattccttgtcatggttattgcttgtggcttctccgcctttttcaccgatttcctgatagaattctttgtcgtgatttttgcttgtggcttctccgcctttttcaccgatttcctgatagaattctttgtcgtgatttttgcttgtggcttctccgcctttttgaccaatttcctgatagaattctttgtcatggttattgcttgtagcttctccgccttttttacctgcttcttctctgctcattttgttattatcttgtgccatttttgaattcctcctttaattggtgttggttgttggtttcccgatttcagaactgataaacaaagaaaacacattgaatgtgttttcgggtggttttttatcattctgtatcgttcatgcgttttagaatccggcgttttttataaagcatgatgcctgtttccgcgatgctttctaaagctgaacggttggcggacgcgccgaagatgatgcctgcggccggaaccatttgcagcagttttttcgcggcgaacgtatcgcggtagctgtaaacgacttcccgccagccttggatttgcgaggcgacgcgctgataggtttggtcgttttgatcatattgccgtaaatcttgcaggatcgctttttttccgatgacgtcactggatgcaagctgaagcaatttgacgataaacacgcgttcttttttgtctttcggatcaaagccgtaagcaaccgcgatatcttgcagcgtctttaaggacaggccgagcatcgccggaatgtctgccgcaagcgtaaacacgccgccgactcccgttgcggctccctgcaccgtcgcggcctttacgcttgtacgcgctatggcttctgcgatttcgtccatgacggcaagcggcgcattgcggatgtcgtgaagcgtttgacatgtaccgtgcggcagccgtttttgaaactttttcatgatgcgcttttctgatgtaaggtactgtccgcctgactgaataaacgttcccgtttcatcgagaatgagtccgattttcctctgaataaattgcggtgtcagcttgtccaaaagctgaaacggcaagcgggtgaatgtttgccagaacatcgccctctgctgcgccttttcccatttttgaatgtctctcagttgtctttccaggtctgtccgctcttctgtcacccgtcctgcacgtcctttctgatttctttctacatagtatacctttatggcgttttctttttacacccggccggactttttatccggaaaacattccattgattaattttcttcaaattctatatattttataattttgaataatacgattgaaggagaatgctgtatgcaatggatttatttaagtttagcgatcatttttgaagtattgggtacgatcagcatgaaattatcaaatggatttacaaaacttgttccaagtattttattgttattgttttatatcggcagcctttgttttcttactttgactttgaaatatataagtgtctccatcgcgtatgcggtctggtcgggaatggggatcgtactgatttccgcgatcggaatttttttctttcatgaacagttctctgttataaaagctgtctctgttcttctgatcatcatcggtgtcgtttccttaaactttatttccgaaagtgaaacgtcatcaaacggcatcagcgttcatacggacagaaacaggtgatgaaagggttaaaggttctcttcctcattacagatattggatttatcatttattggattgttactttttttgagtagattccaaaaaacatggcgtttaaagattatgataacgccatgataatggcctggaactggtcattctttcccctagatattttcatttcattgaccgggctgtacagcttgtttctttataaacggaaacattcgttatggcgccatttcgcattaatatcacttgtgctgaccttttgttcaggcctgcaagcgattgccttttgggtatttatcggtgattttgatctcatgtggtgggcattcaatctgtacttgcttctttatcctttatattttattcggaaattgctggtctctcgtaaaaatagctgtcattctttttgatgaggcggttttctttttcttcaggcgggaaacacttttcataaaggagtgatagacatgccttggtctatgaaggattatccgcaatcattgaagaatctcgaggaacctgtgaagaaaaaagcgatcgaaatcgcgaatgcgatggtagatgagggttatgaagaaggacgggctattcccattgcgacaagtcaggcgaaagagtggaaaaaaaacgcttctaaagaagaaatcgatcagctgatgaaacacgatgatgaaacgaaacgcggaaattgaatcggaatatagaaaaaccccgctctcaagagaacgaggtttttctgcttataaaccgtaataataagatagtgtggtgactgaaacgtagcctgtcgctcctgcatacgtgactttcagccatttattggaattggtgtagtggccttgaacatattctccggtgacccaagaacctgtaatttttttaccgcttgagaatgttgtgatcgttgaacagctgaccttagagcatgagcgcatattagcaccgtaaataccgactgtgcccccgctggctaaaatggaaacgtccggttcagctttaggtttgaaagctgctgctgatgcagagccgccaaaagcgaataaagaaacagcaaaaatcatggctaaagaaatgatcgacaaacgacgtaccaagaaaattccccctcttttatcatatggccggaaagctttcctgacgttattatacttttttgcccggaagactgaaataagtctaatgctccaacttcttttcttcgcaagtgaccatgccgattctttttttgatagataacagccgtttattggactggaatcactgatatatcgttgattcaaacgtttattcagagcggccggagtttttccggaggtcatttgaatggtacagaaaggttttatcttccaatggaaagaaacattattattctatttacccgggaaacggaggaaatactgcgtctttttctcaggatcagttgcaccggacagaaagttgtgaagtgatatgagcaagtgttctcttttcacctttttaaaagaacgctcaacgcatccgcgcatgatcggacgcggaaacatgctttgcgaacggcatcgcttctttcccggaacgatgccgttttcattttcggacctttcttcggcgggatacatatcatagataaaacagggcatcaatgtaccggtttattgaacataaagaacttgacatctcataaaagcggatttatgatgtagataaaataatttgcatctaggaaactttttgttatttagctaaaaatctatcggaatttaggtgagacataatgagcaaagacatctcagcacaatcactgcaagcaaaagccgtgcaggatgcacttgacggcaaaagcaagggattcaagcggcttctgcctttcttaggcccagcctttatcgcggcgattgcctacattgatccgggaaacttcgctacgaatatctcagctggttcgaaatttgggtatatgctgctgtgggtcatcctcttttcaaacttgatggcttttttaatccaagttctttccgcgaagctcggcattgccacgggtaaaaaccttccggaaatcgccagagaccggtatccgaaatgggtatccgccgggctgtggatacagggtgaactggtgattatggcaactgacctggcagaatttatcggggcggcgctcgggctcaacctgctgttcggcataccgatggttgaagcggccattatcgcggcgatcggatcattcgcgattttagagctgcagcgccggggttaccgggcgctggaagcgggcatcgccggacttctgtttgtcgtggtgatcgccttcgctctgcagaccttctttgccaaacctgacgccggctctgttctcgaagggctgtttatcccgaaaattgacggaatggacagtgtgctcttggcaaccgggatactcggcgcaaccgtgatgccgcatgccatttacttacattccgcactgacacagcgccgtgtcgtcggaaaaacggataatgagcggaaaaagatttttagattcgagacgattgacattctcatcgcgatggtgatcgccggggcgattaacgcaagcatgctcatcgtcgccgccgcgcttttcttcaagaacgggctgtatgtagaagatttagacgtggcttatcagcaattcggccactatatcggaccggcttcagccattctcttcgggatcgggctgctggccgcagggctttcaagctcttctgtcggcacattgtcaggcgatattatcatgcagggcttcatccgttaccgtatcccgctttatttgcggcgtttcattaccatcattccgccgatgatcatcattatctcgggggtcaacgccacagaagcgctcgtatggagccaggtcgttctttcattcggcatctcctttgcgctcgtgccgctgattatgtttacaagcaacaaacgcctgatgggcgccctgacgaaccgaaaatgggtgacggctctcgcctggctgattgcggttttggtgatcgcgcttaatctgtttgtgatctacgattcattccgttagaaaaaaaccggccgtagcggccggtttttcttttgacgccggatgccgttcgtatctttttccgggcgtttttggtatgatagaagaaaaatcggagttttgcttatgtcagtatttatccttttttatctgtggattgtgccgattgtcatcggtatcttctgttctctttttgcttatcggacaacgggtaagaaacgtctgattcccggctttgtgatgatcgcattaagtatcgtttccttaatcacggggctttggatcggcggggtgaactatcatgtgttcatcggaggcatgtttttattcggtacgtttttggccggttccgccttcccgtttttcttcgctctctcacgcaaacgaaaataaacaggcatgccgcctgtttattttttttacctaagcctgcattataaaaaccgctccgataatgtgattccgcctcaatcagcctatacatgcaggctccagcccatgttcatttcacgaaactgcagctaaaataaatcctgccaaaaaaaaattttgaattgcgagaaaaatatcgtattaaaatcctatttacccaaaaaatacctattgatagaatggtatctgagagggaaaaatgttcaaagcggatcatacaggtcccgcctaaatacatagtctttcatttctctctacactacatttctaaaggaggatttcccattagacacgcagctaaaggcattctgtttgccgcatctttagcccttgtaactactgcttttgtccccgcatccttagctaaagaaaatcatcataatactgccaatgccactggaacgacaaaatcatttttttatcagactgatacgcaattttcctacggacttaaagcacaaagcgatgcatctgtgtcaaaaccagtcaaagatgtaatcagagaagtgctgaaaaataaaacaaaattattcaatcttgttgaaaaattagcaggaaagaaaataagaaatgaactcgaatccgttttcaatgaacacatcgaaccggttttaaagaaaatgctgaacgagtatgtcgccttaagctggactgacgtggaaaagaatctttatctttcacttaaaaagtccggactttctgacagccaggctaaaaacctcgctcatttgacaactttagcaatgaaagcattttaaaatcattcataaatgatcgtcaggaaaatacgtataaagtaatgcaaagtgctgttagattcactctaatagcactttttcattggagatgtcacatgactgtcttttttactgttttgctcactttcttatgctgccttgtgatttcatctcttatttttatgattctattaaaaaaagagatcgtggatacaccgccaaaccgcttagctcatgcagcattcatcatacttattggattctccctgttcttcgctgtgactgtccccagcctgattatttgttttgcagctgtaacaatacatcattttttcggagagtatatcatctatggttcactttcagacttatacatattttctgtcgtcgtcagtatcttagctttagtttatatgctaatccttacggcaattgtaaaaggaatgactcatgtttttacattacctgcttggtcagcctatatccttgaattcatttttgcatgggctgctgtttacttctcaatccaatacgtttccaatcatatcattgagaacatatctatatttcaaggtggagaaattcttctttcattgttcatcactttcttattttcgggattggatatcctttttactaatttggataagatcacaaaagagaaattaggctaagggggtaacaaatatgaggatcatgacatatatatcttatttttctatttctttagttttgcaggtggtatggctgctattaataaaagatactcctaatatatttctgatagatatgattacggtgtccttcttattcactctctttatgttcatcttggatcaaatgttcaaaaaaaagcggacaaattagggtctgtttttaataatcctcgggcttctctttcgttttgaaattgttccggatctggggatgttgcggcgaaccgttcattaatgtttaacaccagcctcggtaaaatacttctccttttatataacatcctgacttttccgtcatatattcaaacgaaaaaacggcaaaaaggagtaatgaaacatgatattgtttattggcaagttcatgttgctctttttattctgttcgctggcatattatttgtttaaagttgtttattacaatatagggaagaacattgcgcttaaaactccgaaagggacaaagacgaaccggacggcacatgtgtttgtcaaaaatggaactaaactgaatgatggagattactttatgatcgctgttgtgaccgctctctggctgttcttcagatgaaaccgcgctgatccatcacgagttttttgatcagccatcgctcgccagctgccgattttcacaatcatcgttttcgtttaggacgactatatgcaagcaagccgctcaacaaacaaaggagctgtcgagatcttctcgatagctcttttgtttgtccttgaatgattgaagataggcttaaaaatggacggcgtctttctcatgcatgcatcgttcaagaaaacacttcacagcaaaacggaaaggtgaacgcaatacaagtaacggttaagaaccttatgaggcagcgtatgttgattactggataagaaaaagaaatcccccagtcttaaaaggtggaggtcaaaaattggagaacacttaaatatttatagctttttcagcgatataaaaagttccagagtcactcatttcagcagtataaacatttgtcacacttaataatccagtaaaaagaataccgattaaagcggagctgattataagtttcttcattatatagcctccgtaaccttaagtatttgtgtttgggcatgtatggttttctttaaaaagtttcttccctctgcatagtttctcttctcaaaatgaaagtcacctaatttttcggttagctctgcgaaatcagaccaaaggcgtttctcttccaagtaacctaagctttgtttcacttctgtttcattatattcttcgtacaatgaattaatgatttttaatttagccaaatattcctcttcattagaagtccgagcacgatttaaagccgtttcataaaagaaacgtgcttccttggctttatcacattggtacaggacattcgccatcatatataatgatctcactccatacactgtatcaatatgttctttcacgtctattgcctttttgaaattctcttcagcagcaatcaaatttttccctcttaaataaactaagcctgagttatgaaagatcactccgataattcttttcactttttcctcatccaagccacgggcgttacttaatgcttcccgataatatgattctgcctccgtcagcctgtacatatcgtacatgttagcaccgaccatcatattacagccaatcactttcactttgtataattgatttttttcaaacaattgcttggctttttttaaatgattgagggaaacaaagtgctgatcaatttgataataggcatcagctattttgtaatgaaattcagcttgctccatttcatctgatacagcattcaactctctctctgctttgcgataatagcttatcgcatcaacatactctttatgatcaaattcatacattccacgaaaaaataatgagtaatacttcaagaggcctgtaagtcttttttgcggcttttctattttttcaagtagttcgtcgactgtggggcgatctcgatatctgtcttccggctccaaggaatctaacatcaattggtgacgaaagcacatcaatgaataaaaaacaagcaaatcctgatcctcttccatctcctctatttcctgttcgacctcagcctttaaaatctcagcatcaggcacactgaactggcgaatcattttgtaccattcattgatcttgacaccaacttgggacgacggtaaaacttgatccatatatacctctccctctaattgctatttttgtaatattataactatttgaacataaagtgaaaacgaaaaaaaaccgcaatttacttttgcgtcatactcacctgattaacttgttttaagacacagggaaattatacctcaacataaaaatactgtataaaaatactatttacccaaaaaatacctattgatagaatggtttctgaaggaggtggaaaaatattcaaagagaataatataggactatcctaaatacatagtctttcatttcgctggcagattacattcctaaaggaggatttttcattaaacacgtagctaacggtattctattcgccacatctttagcccttgtaactgcttcttttgtccccacatcctgagctgaagaaaaccgagataccactactaatgccactggaattaccaaaccaattttttataataattgataagccgttttccttttagcttaaactggttttaaagaagctattaaacgaatatgttgccttgagttgtattgacgtggagagaatctttatctttcacttaaaaagtctggactttctgacaaggctaaaagcctcgctcattggacaacgttagcgatgaaacattttattgttattcataaattattaggaggaaaatatatatgaagaagaaagtaatccctgtagttttaagcgcaactctacttacatcattcttgggtacttcaggtgctttagcagctgaaaacagaaccacaactcctgtaccggtaacgaaaactgcaccaggtactattccaactggaatgcctggcactattccaaccaaagcggctctcaatggtgactaccaaacccaaggtgtagtttcgtggtcctataaggctttcagagctgcctgccgttcaggtggatggcttttatcaaaagccttaaagccattctcccctaaagctgcggcatggattagaaaaaactctaagaaggttgccgacattatggataaaggtgaaaattggggtgtaaaacaatttacaaaagcttttaaagctatcggagctcctacagatgtagctaccactttagctaaattcattgttgctttgatttaacatatttaaaatttaaagtgctgttagattcactctaatagcactttttcattggaggttaacatggctatctttattaccgtattgctcaccatactatgctgtcttgttatttcatctcttatttttatgattctattaaaaaaggagattgtggatacaccacccaaccacttagctcatatagcattcatagggcttattggattctccctgttcttcgctataactgtacctagcctaggtatttattttgtagctataactgtaaatcattttttcggagagtatatcatctatggttcactttcagacttatacatattttctgttgtcgtaagtattttagctttaatttatatgctaatccttatggcaattgtaaaaggaattactcatatttttaaattacctgcttggttagcctatatacttgaattcatttttgcatgggctgctgtttacttctcaattaaatatgtttccagtaatttcattgaaaacatatctatatttcaaggtggagaaattcttctttcattcttcataactttcttattttcgggcctggatatactttttactaatttggataagatctcaaaagagaaattaggctaataaaaagaaaagcaggcaatttagagcctgcttttttattccctttttaacatttctccaagccttgctttcgttttcggcccgtaaatgccgtcagcaggcagtccatacatggactggaaccgtttgactgcatttgctgtcttcggtccgtaatagccatctattccgttgttctttgcccctttgtccggataataatagagagccgccaaagctgtctggatctgtttcacggccgttcccttagttaaggggcttgtcactttaaaaacgcccgatggcagcgtgtaagatgattttttgccttttgttggagagctggccgagtccgtcagctttaatacttggccgactttgataaaattcgggcccttgatactgttcaatctctggatggtggccatgtttacggcagttttctgtgcaattacagggaggacatctcccttcttgacggtgtacgtcgccacgccagtctttgttcctgtttttgctgataagggctgtgcgatgctaatgagcgaaccacgtttgttatgaactgtcctggccctccaaaagcttttttatcagccatcgcttgctagctgcagattttacgattttctttaccgtttccgcagattttaatacgatatactttcggttacggttcccgtcctctaagcttccaagcgggtcaaactgctgaccacttccttaccatggaagggggtcagtaaagaaataatcatcaataagaaagcctaaaaaaattaacaggcatgctgcctgttaatttttttataaccaccggcttcttaaaacagccgttttaagcttttcttgagtgacggcatttcgattttttggttttcaaagaagtttttcagcatgtatttgctgaagcccttcgcttggccgtaagtgatttttcccggaagcggcggctcgtcgccgatgacggcgtcgatgacgaccggctcatttgagttgagcgcttcatgaaaagcgggagccaattcctcgtgtttcgtcactttgatgccttttgccccgcagctttctgcaaaggcggcgtaatccatattttgcagctgggtgacgtagtcaatgttgcctttgacccgctgttcatattcaatcatgcctaaattttcgttgtttaatatgacaaccgtaatcggcagtttatatttaacagccgtcggcagatcctgcatcaccattgaaaatccgccgtctccgcaaatggcgatggactgccgatcaggttcggcaaggcttgcggcaatcgctcccggaagcccgcatcccattgtggcgagccagcttgagacgataaagtcctgcttcttcattttaaaatggcgggccatccacactgtaaccgttccgacatccactgacaggacggcgtcctctgcggccgcatcctgaagccgggcaatgacctgctgcggcttgagcggatgagtcgcttcggtttcatccttttcgatttccttccaccaatgcttcatgtgctcggtgcaggcgtccaaaaatcttctgtcttctttatattcaatgtattccgtcagctctttcagccccagagccgcatcactgacgattcccgcattgacgggatagcgcttgccgattttcgccggatccgaatcaagctgaatggcgggcgtatcatccgggagataatccctgtacgggaacgatgtgccgagcatgatcagcagatcgcattcctccatggcttcgtaggcgggctttgtgccgatttgcccgagattcccgagaaagtggggatggctgtcaggcacgacgccttttgccggaagagtaatcacaatcggagcggccgctttatcggcgaatgcgagcagctcctcttttgccgattttaacccttggccggcaagaatgaccggtttttttgcgttgttaatatattgcgcgcatgtgacgagatgttcttttttcggctctatatcggctttgaggtatatcggcgatgtgtaaaccggctcccgtttgattttttgcgcgaataaatcatcagaaacggttaaaacggcaacgccttttttgctgtaagccgtgcggatcgcctgattcagaagatcgggcagcgcttctgccgtatgtacctgctggttgaataccgccacgtcctcaaacatctgctctaatttgatttcctgaaagctgtcacggccgatttcatcggaagccacctgtcccgcaatcgccagcaccggaacgccgtccgctttggcgtcgtataaaccgttcagcagatgaacggcccccggtcctgcgattgaaaggcagacaccgatctgcccggtcagttttgcctcagccgcggcagccagggctgcgacttcttcgtgccgggtttggatgaatgtcaggttatttcgttcatgtctcagttcttcgataaattcattaatgctgtctccgggaatgccgtatatatgaccgactccccattgttcaagcagctccgtcattacgtgtcctgctgttttacttggcatactgcatcctccttttacctgtattcatcccctttttcatacgggttgaaacacgggctatactctcagcttttttctcagcagatcaaggatggataacagatttcggtctttaaggactgccttacgatttgccgccccattgagtccgtcttttatttgccgttttctgttcggcaccatgaacagcggcagccggttttgggaaaaccagcgtaaatcggcggtttccgatccgttcatcagcggtgttcctccggtaatggctccgatgaaaacgtgctgtgtatcttcaaatgccggcctttcatactcaccggatttttgcaggatggtcacgttataccctgtttcttcaaaggcctctctgacggctgcggcttcagatgtttcaccttcttcaatcccgcccccgggcaaatcccatagtggaacgtcttttcgttttacgagcaatatgtcccgcccatcattttgtatgatgacaaaagcgccttgtgccatgtcgtcctcctttacaaaaaagaccgcggcatttcagcctgcggtctttccgttactttttaaaatgatacggcagggtggcgacgatgatgtccttcttccaaaacagccggacgcggagcaagaaggctgattggttgtgaaggatggtctgccagcgttttttcgtaataaattgcggaaacagcaccatcacggagaactgttcttttttcgctttttgttcgaccgtttccaaaaacttatcaaacgggtgaaccagactgcggtatgaggaatgcagggtgacgaggcggacgccgttatgaagctcttcccagcgcttttccacctttttttcgtgttctctgtcaaaggaaacatgaaccgcaatgacctgatccgataatgatttcgcatactgaatcgatttttggacgacggtggtgacaccggcgacaggcacgatgacgacggttcccttgatttcctcaggctgctgatcaacgacccgcagctgttcgccgaccgcggtgtagtgatttttaatgacgaaaaacagcatgacgacagcaggcatgaataacagcaccggccagacaagattgaacttcgtcgcgaataaaatacacagcaccataaatgaaatggcggcgccgcatgagttgatcagcatttttaccgcccagcccttcggcttctgcctgatccacttgatgcacattcccgtctgcgacagcgtaaacggaatgaacacgccgacggcataaagcggaattaaatgttccgtgcggccgccgaataaaagaatgagcaggatggacgcgataccgagaaagatgattccgtttgaaaatcctaatcggtcgcctcgtaccgtaaacattctcggcatatactgatcgcgcgctaaattaaacgccagctgcggaaaagcggaaaagcccgtatttgccgcaagcacaagaatcagggatgtcacgccttgaatgaaatagtacaccgtatggcgtccgaaggtttccgcggcgatttgtgaaataacggtctcgttaggcttcggacccgtgccgtagccgtacgccagcaccgtaatccccgtaaataagatcgccagcagaatccccatcatggccaaagtgcgggccgcgtttttcgccggaggatttttaaaggccgggatcgcgtttgaaatggcttccacaccggtcagtgccgagcagccggatgaaaaggccttcagcagcaaaaacagcgtgatgcccgctacgggcgtgccgatcggtgtatgctcggccggatgaacctggcccgtcatgagcttaaacagaccgacgacgatcaaaaggacaagcgccgccacaaacagatagacgggatacgccaaaatggacgccgattctgacagccctctcaaatttaaaatcataatcagaatcacaagcaaaacagcaatgagcaaatgatacgggtgcagggccggaaatgccgatgtaatcgcgtcagttccggcagaaatgcttaccgccaccgtcagaatataatcaacaagcaatgagccgcccgcaatcaggccgggcttctcaccaagattttctttagaaaccatataagcgcctccgccttgcggataagcgtaaataatctgtctgtaggacagaatcaaagcaagcagcaaaatgagaacacccgctgcgatcggaatggaataccaaaacgcggccgcgcttaccgcagccaaaatgatcagaatctgttccgttccgtaagcaactgatgacagcgcgtctgaagaaagcatggcgagcgccttgagtttcgtgagtttctgctctccggccgcctgtgatttcagcggtttcccaatcaaaaatcttttgattgaatggtacattttttgtcttcccctttttttcattttccgtttgatttacaaacccttactgctatgatgtctctgaataacgattgcatgccatatttcggcacagcaaaaagacacagaggcaaacggatgcccctgcgccataatcgtgcacaggtttcattcatctcctctcatgaacgcttacgaggttagctgtcggattcgggctgatgagagttggccctacctgaaaaaggattcaccccaagcggcatgacgcgccgcaaattggttcccccgctctgattacagattaagcgatatagattataaaagagatcatactcccgtcccgttcagttgtaaaggggcttttatgctgtttcaaaaataaaaaaatcaccgccaaaaatggaaataaaaatacaaaaaaagaggcctgttaacggcctctttttccttcattactcttcacttttttcattatccgcttttcttttttccttcttgccgtcagccagatcagaccggccgcaataattataagcgccgcgaaaacagcgatatacgtgacgttcagtgctgcggaacggcttttcgtatcaggcgccggactgctgtcgtcggatttgatttgctgatggtttgaaaacagctgcttgccggccgtttcgttgacgacggttgcggcatcgcttgtgctgtctaaaaagctgatcagctcttttgtgacagacgcgccgctgcctgataacggagcaaaaacagcgatgcttcggccggagtcccaaggtgattcctgggtaaacgcgacttgtttcgttgtctcattcagcatctgaaacgaagaaacatcgtacgcgccgctgcggtctgacggcacgagaagcttagaggcgtttgatttcaaaagcggaatttgcggcaggcctccgataaacacaacattccggcctttggcatccgcttccttcatgtctgatgccgtctttacggtaaagccgtttccgaatgaatccgccaccagagaaagttctttcagtgtctgtatgtttacgtcatccgggatgacgatcactgttttctctttcacgccgcccgcaaacgggagcggccattgcccgaaatccgctttctgcgccgcatcacttaccggatacgtcagcatgctgcttttatcaatatagacccatttattttcgtcacggtcaatacacgggttgttatgtttcaaacctgatgtgacaaattgcagatcaatgtacctgctgcttcgcaaaagcttcggatcaatcgggattgagacgtggtaaaagccatctttatcttgattgccgagatcatcaaggcgcaccgcattcggctgtccgttgatcatgacgttcagctccgctctctcggcgtcattagctgaatccgccttcgtccggatcgattccgacgtctttaatgtaagtgaaagcttgaccttaccgtctttatcaacagcggccgccgcagggtaaaagaagtgctctgacgccgttttgtttgatccgaccgttacatttcccgcgccgaagtcctctaatgtcagtttattgcctgtcttttccgcagcgggctgaaggcggccgattgtcaaagtatctccgcccagctggcttgaataagcgctgtctgtgatgacgcggattttatccgccagcgttttgtctgagtgcgccgtgacaaacaggacgggctgccgtttgtcccctgatgtcagaacccgttcggcgagaaggagtttgttgtcttccgctttgaagttcccccgttcgaaaagctcttttattttcccgttccaatgctgatcagcgccgatgacaattgacggattgctgattttgccggcatcggattcttttacataggataccttcagcctgctgtctgccgttttcagaaatccttctgttttgactgcggcttcagcttccgccgaggtcggtttgtcaggaaggataatatcggtttcttcacccgtattgcctgattgggcaaacggatacgggaaatggccgagatccgctccctttgacttgcttgcttctgaaagcacaaggcggctgtccggataaatttttatccagttgcctgacgtatcctgcctgacgcagacgccctcttttaatacgccgtaaaatcgtaatgatacattgtgatagccttgggcggattggcttttgctgagattgagcttcaccgttttccgcttggagctgccgtcaagctttatggatttgacgggttcatcatcaatggcgatggttaaagaagacggggcaattaataagtttgacgcctcgtaatcaatcagaagcgactgatcggcattcgaagctcccgcaggaatctgataggtcagctctgagctgtctttcgccccgtacagtgtcatcagatcgccagtcagcgcctgctgctcttttgcgccggcgcttgttccgagagcggaaccgtccgttttcagctcccgggccgcggccgcctgcccgttatacatcaatagcaaaaggccagttatcaatatcgcttttttcaaaaaggtcacccgcttttattttgattgtatcgctccgttttgtaccacttgacttcctgcttgaacaatcggtgcttgatctctgtgaataatgaccagatgacgagcacgatccaagcctgagagtatgtaaagtacatcagaaatacgataaagaagttttgtttgttcatttctgttttttcaatgcttaaagtaatcatgacctcagtcataaacaggaaaaaggccagtatccacaaaatcatcgccaaaaacccgactgtcagatgcaggtcgtaaaaaagattgatgataaaaatcgtgtttgacatgatcacaccgaagaaaaacaaaaaatacgtaaaaaagaaataaaacagatcgaagatgatccgcttgcgtttcagcttgaaaaattgggataaaaacttaagaacgacgtactggttgccgcgcgcccatcttgtccgctgacgccaccagaccttccatgtctcaggctcctgctcccatgtcacagccgccgggaaaaagcggatatgatagccgagattatacacgcggatggtcagctcggtatcctccgccagcgccttatcatcccagccgccgagctgttcgataatgctccgcctgatcgcgaagttcgttcccgggatggtggcgattttgaaccatttccatctgccgccctgcgccatccactgaaaacagatggtttcaatattgataaacttcgtcaggatcgttttcgccgcattgataacacggaatttcccgacaaccgctcccgctttctcatcattcatcagaccgagaaccaggtagtacaccgccattttttccggcgtattgtccgcatcatacacgcagatcacgtctccgttcgattccgcgaaccctgagttcagcgccgaagattttccttttccggcgttcgggggctttgtgatgaccattttaatgaagtcatactgacgggaaaattcattgacgatgtctcccgtccggtcggaggaattatcattaacgacaatgatctcaagcctgtctttcggataatacaggttcaccatcgccttcagcgtctgcctgatgacgacctcctcgttatgcgcggggatgagcacgctgaccttcgggagctcccccatctttgcgcgccatttcggaatgttccgttcgaaggtcatataatgcctgaatccgccctgcatcagaaacatgtgatagagaagcatcacccatattaaacttaatgagataaaaaacagaatgttactcaaggcttcttctctccttaaagattcgtttttttaatgtggcgcgcaaataaaggacgtagcaggcgaacatgatgataaacaataacaccacgccggagagaatccaaagcgctttttcaagaggcgtctgctggtgatgattgaaaaaggccgttaccggatgaatcttgttttccacatgaatggttccgtctccgtccgttttgatcctgacgctgtccgacgttaccgtttgcttcgttttcttcagatcgagccactcgccgccgggaatccgctccatctgattgacgagctcgggaaggtatttcatgccgagatacggatggtagaaaccgcccgccgttccgccgccgaaatcaatcatctgagaaatatgattctccatatctccgagcggattttcctttgagttatcggcataaccgattgtttcagggtacagcgtcatcccgtccagcatagccggctttgagacgaacggaggggcgcccgaggttttccacgtcgcgccgctgagctgcacttgtccgaaaatgctggagaaataagaagatgcgattttgtagccttcttcagacatcgtgtagtgcggcgcttcgaatgacagcgggtaaaggccgagctctgtcagatcgtcaatcgcctgctccagcttcgttctcgtgtagatgttttctttttcacggaaaggcttcacatacgcccggtacgctttttcattcggaaaatcctgttccttttcaagcttgaccggagtatcatccgcattttctgacgtaatcggctgatccgctttggcatcccaaaattcaaagccttctcccgtttcgctgtatcggtatgcgtgcgtgtagccgtgaataatgatgctaccgcccatttgctgaagttttttcaggacgctgaccatttttggcttgtccgccaggtatactttttctccgttttccggattgagatagaccggaatgaccgccagaataaacggaatgtgtcttttatgcaggtaagcgcccgcttcgtaaagcaatctttcatctgacatcggactgatgtcttcaagccgcaaataaaggagggtgccgccctctgattctccgaatgcgctgcgcatcgctttcgccgtcagaaacgaatcatttaacaggctcgtcacaccgaaataatagtcagagcgcgccgttttccacataaaagggcgggtgctgccgtcaccggaccggtatgtataaagggactttccttttactcccgatacgccgagcacggacacccccttttcaagcggcatgtctgttttttcttttttgccgtaaatgcggtataccgtttctttttctgtcagggacaaccccgcaaattggcggaactgtccggcgttatagccgatgctgataagctgctgcggcatgctgctgatcagtgacacaaatgatgtgctgagcttttttttcgtgacgccgtaatagatgacgcgccgattctttttgaagtccgcggctgtgatgtctccgtcgcttttcacggtgacggcggatgagaaatggcccgcggtcagatcaagcattttgacctcagcggtttctttgccgtccgtgcttgtataaataatgagaatgccgtcctttttgtcttttgcttccgccggacggggaacataaaccgccgaaatcatgaaaagcgccgagagtaagagacgtatccatttagagttcattcatcatcatctcgttttccagttcatttaaaaattgctcggccgtttgtaaatcctttcggtacgccaagtaacatacacggaaggtgatggagacgtatttaccgttttgcagccggtacgtatccaattcctttttcagcttcgccagaacggccggcatgttttcttcaggcgtatgggtcagcacgatgccgaaccgttcggcggacggcctgaattttttgtctgtttcccgaacgcttgaccggatttggcggctgataaacgccagcagccgatcggtctctttttctccgtatagggatttgaattccttgaaataatgcatgtgcagcagcaaaaagacgaaggaattgccgtagcgttccgcccgcttgatttcctcggaaagctccagcttcatccgcagatggttgtcaaagccggtcaccctgtcgacggcgacaaagctcgtaatctcttcacgcagctgtttcactgagcgttcaagccccttcgccaactcgtgaatccttcccgctatgtaagaaaagagcagcagcgcaatcccccaaatgaccagcacctgcagactttcggcatcggcagacgccataaagctcccggtctgaaaccacaggagcaggctgccgagaacaaataagacgagtaaggtcatgacgagcgcgtagattgccccgaaccatataccggctcccgcaacaagcaatgtgatgcaggttatcagaagccctgcggattgctgagacgcatagtaaataaaaaaagacagcagcaccagcataactgctgtgtagctgcacagtttttgtgattcattgaatgatattttcattaaacaatttcctttcagccagaagcggcagcaggttatcgaaagaatgtgtatcgctcccgctcatatagccgccgtaatcgggtttcagcgtgtccagtgtttcaaatgaagtcattctttcataaagcggcttgatgacagccggatcagctttttgttctgctaaaaaaagaacggccagggcgtaaacggacggtgattcgtactgaaccgccggctccttcgtgtctgcgctgtatcgtccgtacagctgtccgcgcgacttaaattcctctatcatccattttgacagcgcggcagccttgccatcgccccgcttcagattcacggcggcgtacagctggtcgatgacattcacttcgctgtcatatttgtattcctttgtttcggtattgaatgatttcggcagaaaaccatttttcaggggagctcgattgagaacatcaaggttccggttttccgttttctcatcgataatccctttttctctgagcatctgtaaggcgccggggtcaacataggacaaggtcacggtctttgatgcggcatttgaagcggcatcataataatccgtaaaatacccgtcatttgtattgtatttttccagcgccttcccgatctgcaccgctgttttcccgtattcactgtttccccacagggttccggcctcattcagacagttcatgattctgaaatcgtcaattaaggcattggtgccgctcgctttattcccgtcaatcttccacgacacgagcccgtttttcgtcagaaacgaatcggtgagaagctgatattgcgcttgaaactgccgttcatctttcctgttcagcaaaaatgccatccatagtccgagagactcagataaatattccggctcaccggatatgttcgtccggatcatcccccgcccgttcatcaatttatgataaataaaatgctctgcgggctgaagcggtccggacggttcggccgccgtctgtttttcaggtccggcctccgcgcaccccgccgtcagaacgattgaaatcaaaaggatcatcagacgaaaaacgaattgcttcacagtccatcctcctattttacaaatccttttttagacccatatcttattttttcacaaagtatttttactataaaggaaacgataaaagaatactagcattttttcacattggaaaattttaaatggaagcgccgcctctcaccttttccctcttcacatggatcgtattcccattacagtaaaaaacacaacaaaaggcagcatttctttacaaatgctgcctttctctgatctatttatccaggccgagttttttcagctgttctgccagcgcgttgttcatcggctcctctttgttttggcttttcatataagagttaatgtcccgcttggatgcgcgtccggatttatctttcgccttccgcttttcaaagacggacagtttctcccggtggccgcatacacatgcgaaggtttggccttcgccctggccgcgaagctccattttcttatgacagttcggacagcgggcgtttgtttttcttgccagcgttttccggctgccgcactcacgatcctgacatacgagcatcgtgccgcgtttgccgttgactttaagcatcattttgccgcaatcagggcaggcggtgcctgaaatgttgtcatgtctgaaagtctggctgctgtttttgatctccttcaccgttttgcccgcatatgttttcatgtctttaatgaacacggcggatttcagtttgcccgctgcgatggcggagagcttttgctcccattcagcggttaaggccggcgatttcaaatcttccgggacgagctgtaagagctgcttcccttttgacgtaatgaaaatatctttttcttttttctcgatcaagaaactgttgaacagtttttcaatgatatcagcgcgggtggcgactgttccgagtccgccggtttcacccaatgttttcacaaggttcttctcttctccctgcataaaggcgcttgggttctccatcgcggataacagcgtgccttcattaaagcgcgccggcggtttcgtctgaccgctcgtttctttcaatgatgagacagtgaggcgctgcccctgctgaagatccgggagcgtctggtctttgtcttcctcatgatcgtcgtcatcctcgtacatatcatacacggctttccagccaggcgattgaaccgttttcccttttgcggtaaatgtttcgccgccgatatcggctgtgacctttgtttcttcgtattcgaacgccggcattaacacggcgagaaaacgtttggcaatcagatcgtaaagctttcgttctttgtcgctgaggcttgaaaggatcagcggctcctctgtcggaatgatggcatggtgatccgatactttcgcatcattgacgaatcctttatgcgctttgacgccccgcttcagtatttgattgacgtactgggcgtacggcttaacttccatgccgtttaaacggtcttttaaagtcggcacgatgtctgcggaaaggaatctggaatccgtccgcgggtaagtgacaagcttatgctgttcatacagcttttgaagcacggacagcgtctcttttgcggagaaaccgaagcgcttatgagcgtcccgctgcaattccgtcaagtcgtaaagaccgggagcgaagctttttttcgccgtttttttcaattctgaaatgactgccggctttccttgcaggtcttttgccaaacggccggtcaccgtctgatcgaacgttcttgtctgttttgtttttttatcctgccatgtcagcgtcatctgatcagccgccgcgcggaggccgtaataaggaacgggtttgaacgcctgaatatccgcttcgcgtttggcgatcatcgccagtgtcggagtctggacgcgtccgcatgacagctgcgcgttaaatttcgtggtcagggcgcgggtcgcgttgatgccgacgatccaatccgcttccgctctggcaacagcggaatgatacaggttttcgtactctttgccgctgcggagcttttgaaatccttctttaatcgccttatccgtcacagaggaaatccacagccgcttaatcggtttgcggacgtttgccttttcgataatccagcgggccacaagttccccttcccgtcctgcgtctgtagcgattacgatctggctgacgtctttccggacaagctgagctttgaccgcattgaactgttttcctgtttttttaatgacgacgagctttaaaggctccggaataatcggaagatcctcaagccgccatgattgaaattctttgccgtatccttcggggtcagcgagcgttaccagatgcccgagcgcccatgtgacgatgtagcggtcgccttcaagatatccgtttccttttttatgacacttcagaacacgggccaagtcccggccgactgaaggtttttcagctaatacaactgtttttgacatgcttttcacttctctttctttcacactcatcctgttattataacagacttcctcacgctctctctaatcgaggacgttttttgtgtcaatttctgagaaaatgacgtgggtcacggtttgggcatacggagaggtgcggttgatgaagtgttcgatcgtttccagactgtccgcgttaatcttcagcatataacacgccgccccggcgacccgaaaacaaaattcaatgttgggaatggattgaatgtaggttttgaattgatcgtattttccgtttttcaccgtcgcttcgacaatgcaggagacggggagcccgatctttttttgatcaatgtccaatgtatagcgcttaataacgccgaaggattcaagctgtctgacacgctctgtgacggacggggctgacaatttgatttttctgcccagctcccgcatggacaggcggctgtcccgctgcagctctttaatgatgctcagatccacattatctagtttcatgactgtagtccttccttacccttttggctatattatcaagagaaatccgaaaaatgacaagaacaacaggctgaaatcatgaaggttttttcaggaactgacgcgaaatggtcatattaggactgccctttgcttatagtatagaggaaaaaagatgtccgacaggagggagctgtatgttacacacgccgatcggcagacttcgcacgatggggtttattgaaggaatgtcgcttttggtgctgctgtttatcgcgatgccgctgaagtattgggctcatcatccgctcgccgtcaccattgccggttccattcacggcggtttgtttatcatttatctggcggtgctggcgtatgcggcgtttactgtcaaatggcatgtgaaatggtcagccgccggttttatcgcggcctttattccgttcggtaattttatttatgatcgcggcctgagaaattatcaataaaaaagctcctcttctgcagaggagcttttttcatgcgttacatccatttcgtcacccaggcgatataataagcgccggggatgaatacgagctgggcgagaagcgtgcccgcgacccttgatgtgaccatcgtcaatgaggtccattttaaggagacgtagctgcgcttgcccttcgccacatcgtctgccagtacggagactttcgggtcaacaaacacggccagcagcatagtcgcaacgccgttgattaagcctgatgccataacggccgtcgtgctgtgctcaggcgccagaaggccggcgtacagagcggacagaacaccgatcgtgtaaatagacgtaatgaccatattaatgacaaacaagcgtttcggaatcattcggaattgaagcccctttaaataggagactgacggcagtctgatataagaacgcgcatgcttcagcccgttcagtgaaaatccttttttaaatacctgcatgacggagcctcctccgtccgccaagtgtataatcgccctggagaataacgcgacgaatgtcggcaaaagacagatgccgagcatcgttccgaccgtggagccgaatattaaaaatcgaaactgagcgcccacaacagacagagcgtttgatccggcggcatcaatcagatgtccggtaaacggctgctgaaccatgtttgacatgcgcgacacaataaccatgacattaaataatgacagcgcggacgcgataaatccgactctcgcgccggaaagccgtgttgcataggcaagcgtttcaatcgaatgtatcagcagcagaaaacagaagataaacagtacttgtgaagtaataacgtgcaatgtatgattcctccaaatcttttcatactgattagactctgcagactgcggcaaggtttcggccgtttacataaaaaaaccgcccggatgtccggcgcggttttgtcttattcttttcttacgcaaataaataatatatggttgcccgccttagcctgcgggtgattcgtattaacagttccgacagaatcattcttcgaaagtaaacaccatggaagttcttgaacacaagacaacgaaagccctacctctcaatcgtcactgcggctccgaagccgcgccggtgtgaattgtaaaacaaaaagtcttttttccatctcttcgttaggggcgaatatcagaaggaaaagaataagctcagctttttttcaagctgtccgttgaagcctgaagcttctatatcaaaacagaaaaaagaagtttactttcttttttatttgcatgttgtcacttagcagttaagtataacagattgcccctgaataatcaaatgatttattaaagttccagctcggccggcgttttttcacccgcattcatgagcttgatctgcttcggttcaatttcgagaatcaccaggttcggatcgtcttttccgtcaaaccagcgttccagtttcggatcccacagcttttcttttaaatctgctgagttgttcagtttggcggttccggccacttccacataagcgtcaccgaatccttcacagtcataccctaacagaatatgaacattcggattgttttcaatttcttccgctttatgagtgtctttgctcgtcggcgtgtaaatcgttaagccgtcatggaaaaatgtcatgtagcgtgaatgcggtttgccttgctctaccgtcgcaagcgaaccgactttatgatgatccagtacttcaagcactttttctttgatttcattttgattcatgaagaatcactcctttttaacgtctccgctgttacttttccacattggggagacatttaaaccaagaaatgtgctcttctgccgatcttcgctccattcccgcttcagcatgctgtagttcaccgtgtcatgataggcgccctgtacaaaaatgccttctctcgtcagtccttctttctgaaatccgagccgttccgccaccgccctgcttttcgtgtttttttcagccgcgctgatcatgatgcggttcagcccgaggtcctgaaatgcatgggtgatgaccgcccggcagcttgcggtgataatgccgaatccttcatgctctcgatccagccagtagccgatctctgctttttgattgactgtatcgacattatggatgctgatcatgccgcaaaaccggcccttcacaaaaattccggcgtcaaacccattctcttccgcatatttatagcgccattcggggatgatcacatcgcggtacgtatcgatgtcagccagttcttccgcccagctgagccattcgctgagatggttttgatttcgcttcataacagaatacaattcgtccgtatcttctttggcaagcaatctgatcgtcagatgttcccggatttgacaggaaaacacgaccgcaccttctttcctttattagccattatacaggtaaatttatttttttccatacaaaaaagatgaggcgtgcagcctcatccttaaatgcgcgggtcggtgaaaacatcgtgatcatccgtgcttgtcgatgacatttccgtaacgaccgccccttcttctcccgcttgaaaccaatgcttcgtatccggcggaatggtgtattgtccgcccggctcaagcacaatctcatgccagacggtgtagtattccttgtcttcttccggcgggaggacgcttgggttctctgtcttttcgccttccacgtagagatacaccttcccccagcggcatcggaatgtctcttgttttcccttctcgccgccgaccggcggatggcggtgttccggacacgtctggcgcgggaagagcaccaattctttcgaacagtagcggtcggtattcacgtaaataaacagctgaagcccggtttcctcaagcttgcctaagccgtaatccatgatttgaatgtcttcgacttcatcatcagtcagaacgattcccgctttttgatagtatgcattcacgtcatgtttcgatatcgtcatcggtcagcctccttatgtggtcacaaatctgccgccgttgacatgcagcgtctgtccggtcatataagaggattcgtctgaggccaagagcacatagcagccgacatgctcaacaggctggcctgcccggcccatcggcgtatcctgaccgaaggaagcgactgtttcttctgagaatgtcgccggaataagcggtgtccagatcggccccggcgccacggcgttgacacggataccatcgttgacgagcgcttgcgccatggatctcgtaaaaccgttaatcgcgcctttcgtagccgtgtagtcaatcagctgcgggttgcctgtgtaaggattaatggatgtcgtattgatgatcgcgctgcccggcttcatgtaatcaatcgcttttttagtcaaataaaattgtgagtaaaagtttgtcttaaaggttctgtgaagctgctcgcttgtgatgtctttaatgctttctttcggatgctgttccgcggcgttattcacgagaatatcaagacgcccgaattcttcaaccgttttttcaacggcttcattgcaaaagtcttcctcaccgacatcgccggggattaacagacattttacgccttcttcttccactcgtttttttgtatcttccgcatcatcgtgttcatcaaaatagacgatcgcgacatttgcgccttccttcgcgtaagcaaccgcaacggcgcgtccgataccgctgtcgccccctgtgatgagcgcggttttcccttttaatttgtcagcgcctttatattctttgtattcgtaaacaggcgccggattcatttcgctttcaatgcccggctggcggttttgtgattccgccgggaattccttcggatagttttccatgtcaagttcctccttctggttcgttgtcatatttcttgtctacctctgctgtcttccggataaacatgattgagacagttcaaaacgttttcggagaaaaatgtttcacatggaacgcaagaaaaaaacccggctggcagccgggtttttgttctctattatgaacgtaccgcttgtttgcggagcacgtcttttctcacttttccaaggttgtttttcggaagttcgctgacgaactcaatgtccggaattttaaaggcagcaagacgttcttgaaggaatcgggtcacttcttcttctgtcaggtcttctctgccgtttgtcacgatgaacgctttcggcttttcgccgtagagcggatcagggataccgacaaccgccgtttcgagaattcccggcacttgctgaatgacttcttcaatctggtcaggataaatattatcgccgccgtagatgatgacatctttataacgtccggtgataaagataaatccgtcttcatccacatagccggaatcgccggtatggaaccagccgtctttcagcacttttcgtgtcgcttcttcgttaccttcgtagcctttgaataaaaacggacttgtcacaacgacttctccaattgagccttgcggaaggacttcacctgtttccggatctacaacgcggacgtccacttcttccatcggtttacccgcggaagcggctttatccattcccatttgcggattccaagagctgatgccccacgcttccgtgcttccgtatccgtgcatgagcgggatgccgatgtcgagatactgctggatcaggctgcttggcacctttgtgcctcccgtcatcatataaacgatagaagacatgtcagtctggtgcgtttcccatgctttcagcaggtatgtgaaatagactggcagcgccatgatggtttgaattttttctttttcgatgagcttcaagttttccacagggtcctgattgtctgtcataatgaatgtcgttccgctcatcgtgccgaccatctggcagataatcgcgctcgtatggtaattcggatggcatgctaagaagcggacatgctgcattctccccgtgtaagccaatgtcgcgtttacgtagttgtatatgccgccgtgagtgatcatgcagcgtttcggattgccggttgtacctgaggtaaacatcagcaatgccgtatcgttttcagacaccgtttcgacatccggtgtatcaccggagcctgtcaataaagcgtcaaactcaggcgttgtctccgcagctgttcctgtctcgatcttcagtttaagagaagataccagcgcaggaagaacttcttccataatctctttaaattcagtgccgaaaaagacagctttcggttcacaggctgctaaaatgcctttcatttcgtaaggtgttaattgccagctgaccggcacaacaaccgcgccgatttcgagtgccgcaaacatgacaatggatgacgcgtggccgtttttgcaaagcatcgccactctgtcgcctttttttattcctttatcaagaagcgcttgtgcaagctggttgattcgttttcgatattccgcgtaggtcagggtatgcgcaccgctttttacagcttcgatctcttcgctatttgaaatgtcatgcagaatcatatgctgtaatgtctccatattttcatctcccataatcataaatcacaaaaaactctgtcagattttcttcctcacgcaacccattttaaaccaaaaaatataacttgtaaaacaattttgttttagaactattccattcgtgaatgatacaatagtcccatgtttttagtttcttcccttccccttaccctcatacatgcagaaaaaaacacaccccatatgaggtgtgcgctttctgtttaccgctgtcctttctcctgaatgaaatgataaaacagcttgtttaaacgtttgtataaatcggcttcatcctccgtctggaaggcttttatactgtcttcggactcgatgatggcggagctgaccgcacttagtatttccgacccttcagcgggcatatcagccggcgccatcatcaccaaagcgcggccgacggtcagggaatttccgtccatgcctttgacactgcatggagctgtcaaatcataaattttgaaaaaaggcgtgacaatttcttcatttttgagatggtacagcgccatcgccgttcccggaatgccgagtccgccctgtcgttcacgctctgcaaggcgctgtgcggtttgtttggcattacggacaaatccttcttgctcaagcatggcaaacaaacgattcaaaaacagttcgtacgccgtgtttgactcaatggatttgatcgaaaagttccgcagcacgctttggataaccgccgcataatgtgccatacggccggccgcttccagcatatcaggcgtctccggctgcttctcttctcttttaccgtttctttttttgtcaagaatcagcggaatttttcttttgatgtactgcttcacctgatcagcgtcttcttcgtttaaaagcggactgaccatgacgtaatcaatgtttccatacgggatcggaacggtggatacgatcatgtcatacgcggtgatgtctcggtccttcagttcgatgagggaagacatatcaaaggaacggatttccggaagctcctttttcagtctggatgcgagcattttggacgacccgatgccgctggaacagacgatcagcgctttgatcttcgcttcttcccgtttgatttccagagcggagccgaagtgaagaacgatgaaagcgatctcatcatcagagaaaagaagccccggaaagaatttttccattccttcttctacggccatgtacagcagaaagtagtcgcgtttaatttgctcggtcatcgggttgtacatgtcgatattttctttcacccggttgatcgcaggctccagatgggcgattaaaccgtcgtataaagaaccgttttccgtcagatcaattttgattttttcagaaatgaagccgatcagctgcttcgtttgcaaggccgtttcaacttcaatgttttccggtttgaattccgttttgtattggcggttggcgctccgcaaatgaatggtgatataaccgatctcagcttccggaattgaaacgccaaacgctttttcaagctcttttgccatttccatcgcagagccgtactccttcgtctgctgcagcgcttttagttccgaagcctccatcgtgatggtttctccgagtctgattcggtccatcgcaaaggttaaatgaaccgcaagcgccatgtatgagctgtcagataaggcgatcgcgattttttccttgagctgaatcaagagccggtccattttcaaaagttccgctttatttacgaccccgaacattttttcagcatcgtcaggttttcctttaatattgaattcaaccgcttccaaaaagctctgaatatcaagccggttgacgatgagattgccgacgattttccgtttcgcattttccggacccgtcagctgtatgccgaagcccctttttcggatcagcgtcaagccgaagggcgcgatccaggtctccagctcatccagatcataactgattgtcgcgtttgtcacttgcaattcgttcgccagactgtagagcttgatcggctcttgcgactctaatagtgaacatagaattaaaagtttccgctcctcagcgctgtattcatgctgttcataggacaggtctgacaggagtttttgtttgtcctccgggtttcctaccgctttcagtcctttgccgggctgtttatcaagtgccagaccgaatgattccatcatcggtttgattgtttttaactcgcggtgaacggttcttgtgctgacttgtaaagcttctgccagttcatgcactgtctcgtaacggttctgcagtaatagatgtttcattaatttttgttctctcgctgtcatatacatgaaacgcgcctccagattttctagttgtgagaagtatggcatatggggagtgctgccggggaaagtggtgtaaattataatataaaacgctttcaatgattattcaaccattttcaaatggcaatttggcactggaccgtgtgacagtattgaaaaagaaaaatgtgtcagataatatgccatgacgcttgttactcttgatccgcacggctatacttcaaagtgaccttacttgtttttagacattgcacaccacataaacaaacgcccggaagataccttccgggcgtttgttctgtttatggaatatcgcagccttggacaccggtataaatcctgaaccactgatcatggctgagtttgtacgcggatgcacgcaccgcggcggaaatgcggttctcttttccgctgccgacaatcggcatgatgtctgccgggtgggtgaacagccatgcgtacatgacttcgtcaatggaagcggcgccgatttcttcctgtacggaacgaagcgcggcacggattcggagggccttatctgattgtcctgtaaagacgctcccgcccgcaagcggtgaccacgccatcggcggaatgcgtttttccagacagaaatccagcgtgccgtcatgaatattttccagcttgtacgccgagatttcaatttggtttgtgacgagcggatcatccaaataggattcgagcattctgtactggtgcgctttaaagttcgataccccgaaatatctgaccttgcccgagcttttcagcgcgtgaaacgcttcagccacagcctccgggtccataagcgggtccggtctgtgaatgagcagcacatccagataatccgtattcagattcaaaagcgactgctccgccgacgctaagatgtgagacttcgacgtattataatgatgcgacttgtttcctggccgctccggtgattcaatgacaatcccgcattttgtgacgatttcgattcgctcccttattgaaggcgaaagggacaaagcgccgccgaacagcttttcacacgtataaccgccgtatatatcggcatgatcgaaggtggtgatgccttggctgatacaccattcaatcagattcagcagctctccgtctgaaacattccattcgttcagacgccaaagcccgtgtatcactcttgaaaattccaggtcttcagccaattgaatgcgctgcatgtgaaatccccctttttcttagagcctcttgtatctctgttttcaggaattgcccatgctgtttcattctgcttcggcggccgattttcctttcagcccgcaaaaatcgtcatttaatgattctgaaactgctttttcgctttttcaacgacgtaatggcttccgccgcgttttttgacgtcttgaatcatcatcgcgatcaagaggtctttctttttataatcgtaaccgacaaaccagccgttttctttgccgtctttatcttctttagacgttttcagctcggctgtaccggtttttccggctacggtaatgccgcttacggccggctgatatgcagagccgcgcggatcttcaacgacgcctctcagccctttcgtgatttcttcggcattggctttcgacaccacttgcttatgccagatttgcggtgttttttctccgtctttgatcaatgtcggtttgacgagatttccgtctgttacaaatgcggtatagtcagccgctaagtgcagcggagacatcagcatctgcccctggccgtagcccgtatctccgagaaggatctcggaatctagcttgccgttagcgattgaggacttttcaatcggaaattggtacggaatctcttcatcaaagccaaatgtttttaatccttttgtaaacgcgtccgctccggcatctatggcattttgcgcaaagtagatgttgtccgatgtgatcagcgcgttttcgagatccacttcattcaggcgctctgatacgcgtgtgacatggtaaccgccccagctcgaatctttctgccactcttttccggtgatttttttcttttccgatgctttcaatgtgccgtttgtcaggccgactgccgcggcaatcggtttaatcgttgatcccggcgcataaagtttgttgaatttcgctgaaaacggattgtttttatcttcattcagctttttccactcttttccgctccagccgaaaagaaagccgttcgggtcataagacggtgcgctgacgagcgcgagtgtctctcccgtttgcggttcgagggcgactgccgctccgctgtcatctttcatagaatcatacagcttcgtctgcgttttcatgtcaatcgttacatgaatatcctgcccgctttcggctttcttttcagcaatgacctcacctgtttgcgggacgtaaattttccagccggtcttgccgcgcagcttgtcttcatatacattctcaaggccggcgatgccgattttggaagtatcgctgtattggccgtctttcgcttttttcagctgctccgctgtgatggttttaatatagccggtcagatgggccgttttttcgccgtacggatagtagcgggagctgactttcgttttcgtcacgccgtctaatgcaagcaggcttttgaccttgctttcatcatccggtctgattttttgaatcgggacataggagtcgtcttttacccagccctggttcagtttgcttttgatatcgtcttcagaaaggtccagtttttcagacagtttttggatcacgctgtctttatccttgccgagttttccagggataatgccgatttccggcacctcggtattcacggcgagaccttttccgtctttgtcgtaaatttgtccgcgcttcggttcctcatttgcgatctgcacggttttgtcatcggaaagctgtttgaaaataaaagaaggattccagtcaatgttccatgattctccatcgtctgttttctcttttttcaggacggccgtgttttcaaaagcgaccttccctgcttttgtatccatgctgactttataatcgatgtgctggaggtcatcttttttcttatcgtcttcgtcctgtttttcggcagtgactttcagatttttgacccctgcttgttcataaatggtttcatatcgttttacaaaatcctttttggatcgttttttcttttcatcctgggtgaggctttggtacatcttatcgtaatgaccgccgttccagtcttttacgaaatctttcattctgtcttcggccgattccgttttcgagcagccgatcaaacctatgattcctgcgagtaaaagtaataggtataacccttttttcactgtcaattcccctgccttccaactgttattttctcctaaaccaaatcaggctggcaaggatttttttctcatagcgtttaaaatttttttgtttttccggccgtcacggcccatatttttatacaatgtatctattaaaaaaaggaggaatttcagatgatcagagaagcagccatgctgtatgtaaaagaaggtcttgagggggaattcgaagaggcattccgccgggcggagccgattatcgcgggcatgaaaggttatctgtcccattccttgtccaaatgtatggaaaagacgcataaatatttgctgcttgtggaatgggagacattagaagatcatacaaaaggctttcgcggatcgccggaatatcaggagtggaaagccttactgcaccgtttttattcaccatttcccgttgtggagcattttcaggatctatcagactcagatcgcgtgaagcgtaaaaccgattaaggagatcgaccatacaaaaacggcggtatagatattgaatttcccggagccgtcgttttctttccgtttttcctccagcccctgaatgaacatgaccgcaccgagaaacacgagcataaccggctgtatgacggaggtatgttccgcatacgtaaatgcggcggccgcaagtataataatcagcatcgcgagtgacagttttaaggcgcgcagcaaagcaatccatcctttctgttatcattttttgaacacaattctatttctgtctttatcccccattattctagcgtactttttgcgcggatagaacgaaagtcggacaattttaagtttgttttaaggagcacgaaaagcgcgctccccatgaaaaggagcgcgcggtttatgagcgggcgaggcttccgtatccgagcccccgcaggacgcatgccatgacttcataccccttgctgttggggtgtacgcggtcataagaaagatattcattcatttttcctttgaaagcgctgtggacgtcggcaattttgacgtgcggcgccgatgcgagtgtgctgaggtgcgcattataagaggatatccatttttctgcaatggagatgcccgggaaaggattgtataaattgaagacgcggatctcataaggagacgggtgcgacccttttaaggcagcaatcttggttatcatcttttcaaagttctcatggcagtgactggacacgctggtgaataccgaagcgtccgatgtttgctgatatgcctgaaccgaatcgatcaaatcgttgccgcagcctgtaatcgtaatcatatcagcagcctgaatccgcctctgaatgtacgggaaggacataagcccgagaatttctcccgtctcaaggcctgatttggcaaagatggatacgtcggttcttgtctgtaaatcttctgccatcatgcgcccgaaccgctggacaaaaccggcggaaaacggcccggatcccctccccgtcgtcaaagaatcccccagcgccgtataaacaagtcccatttactttcctccactcgttactatcgatattgtaatgtacgcgagtgaagaaaaattggctcggtcaataacctaatttctcagaaatatgctgtgcggcgtttttgaccttttcggttaaatacggcagcctgtcctctgaaaaccgggcttcgaagccggcgatgctgattccagcagccaccttaccttcgtgattgaaaatcggcgccccgatcgccgccgtataatcttctaattccgaatagctgatcgtataacctgattgcaaggatctttcaatggagtgaagcagttcagcccgatccgtcatcgtgcctgaggcgattgcggcaagctttgtcttctgaatgtatgtgtcaatctcctcttccggcagaaacgataaaatgcttctggcgcaagctcccgcgtacagcggcgaccggcggccgattgccgtatacaggcggacggtttgggtgccttcaattttttcgacgtaaatggcttcatccccgtccctcatgatcagctgaacggcctcatccacttcgctgcacagctcttccataatcggtttggctattttcctgatatccagacgttcagagacgagctggccgaattgtaaaaagatcagaccaagctgataacggccgtccgccgcccgggtgagaaaccctgtttcctccagtgagcttgccatccggtgaaccgaagtcttcggcatttccgatagagaaaccagctcatttaagctcaggctcggttcagtgagaaacaaatgaagcagttccattgatttgatgacggttttgtttttgttttccatggtctttagcccctttgtcagatcagccattccattttgagccttgctttcagctccttcagctgctgttccttctccaaaagcagcatttccgcttcctccagcgaaacggcccggaacgtaatatgttcccccggcatcgtttgggcgacgaggggaagatcggcggatatgatatgcgccattcgcggatagccccccgtcgtctgtctgtcagccagcagaataatcggattgccgtccggcggcacctgcaccgttccgaacgtcacagcctcagataccatttccagcggctcccgcaattcaagcggagcgcccttcagccggtagcccattcggtcggattgaggcgtgaccgtatatgactcttgataaaaacgtaattttgcttcttctgtaaaagcgtgaaattgagcgccttcaagcactcgtatgaccggattttttttcagcggcagaaaccctctgctgctgacagaccaatcaggcgctgagaaaccatactgtccgaaagaatcgctcagacggtacgcgattgattccgaacatggcgtcatacggccgagcggcagctcatcatctttttgcagcgctcttccgcaaaagccgccgatccccgctctgacatacgtgcttttgctttccatgacggcgggcacatcaaatccccccgcgacggcgagataagcgcggctccccatcttgcacggcccgaatgagacgacgctgttttcctttatcaaaaccggtttccacagaggggcgggctccccattaatatgaaaggcgaaatccgcccccgtaacggcaataaccgcgggttctgagaactcaaaggaaggccctggccccataagcgtaacttcaagccccgcctctttttcttgatttccggcaagaagattggcgatgcgcagagagatcgtatccattgcgccgcttcccagcacaccgtatttctgatatcccgtccgccccgtgtcctgaaccgtcgtcaagagaccgggttttaccactttcatactcattcggctccctccttgatgcggctgtactcctctgctgtgatccggacgaatttcaccgtatcacccgctctcaatagactcggcggatgttcttccggcctgaaaagccggagcggggtgctgccgatcagctgccagccgccgggagtggatatcggatacacaccggtctgcattcccgcgattcctactgaaccggccgggatggacggccttggcgacgcctttctcggcgctctgatccgctcagacattccacctaaaaacggaaatcccggcgcaaatccaagcatataaacgagatattcgccttcagtatgaatgcggatgacgtcttccggggtcagatcgttcatttcagcgacctcttctaaatcgggaccgaaatctccgccgtagcaaacggggatttccatcacccggcgctcttttttgcggccggtcattatatggctgagacgttctgtcacttctttcttgaccagggcaaaaggagagacgcctttttttatgtttgagacggcagacacgtcataaaagaccgttaagcttgtgaatgccggaatacattcaacgaagcccggaaacggccgttcttccatacaggctgccgccgcctgcacccggctgttgacctcttcgctgatgtgcccgccaaagcggatgataacggcggaatcaccgtacggctgtatatcaagcgctgtatttccgctatactgcatcattgtcatcacctcgttgtattctttctcacttacaggacagcaagcgattcattttgtatatcggtgatcagcatgtgccccggtgaatgtgttattacgatatcaggctttgcttccatgatcaccgcctggggtgtaacgccgcaagcccagaatacgggaacttcaccttcccgcaccgttacggcatctccgaaatccggctgatgcaaatcgctgatgccgatgctttgcggatttccgatgcggacgggggcgccgtgcacggcgggaaaacgtgacgtgacctgcgccgcgcggactgccagcctttccggaatcggtctcatgctgacgaccatttttcctgaaaacgggcccgccggaatacagtcaatatttgttttatacatgggaacgttcacgccttcatcgatgtgcctgatcgggatgtgctgattaataagggcctgctcgaatgaaaaactgcagccgatcaaaaacccgacataattatccttccaatacggcgtaatatccgttacctcttcagtaagcacgccatgccgataaatcctgtatttcggaaagtccgtccggatatcagctcccggcgccgctattgccggaacgggtgaacccgcatccgtcacatcaagcaccggacaaggcttttgattacgctggcagaataagagaaaatcaaaggcaagatccttttgcaaaacgacgagattggcttgtgcgtaagaagcggccaaccccgccgtcggcccggtcatctgccctttcctgataagctgtctgacttcttcgggactcatatcactcatatggtttttcatatcatcagctccatagctgcggcatttgcgagaataatgtatagatgcccataaccgccatgacaaccactacgatcgcccctgcaatcgtgagccagatcggatgcttgtaatcgccgacgatttttttcttataggcgcccaacagaatcatcgctaatgcaagcggcagaattaagccgttaagcgaaccgaccgcgaccagaattttggcaggctggccgatcgtgacaaaaataagagtggatacaataataaaaccgataattacgccatgtgagtgcttttcgatttttgccgaaaacgatttgaagaatgacaccgatgtataggcggcgccgatgacagacgtgatagcggcagaccacatgatgacgccgaaaattttatagccgacatttcccgccgcaagccggaatacagaagccgcgggattatcaggatcgatgcgcaggccctttgaaacgacgccgagcacggcgagaaacagggcaatccgcataacagatgtaatcaagacgcctgtgacggagcttttcgtcacctgaggaatgacttccttcccttggatgcctgaatcaagcaagcgatggcctccggcaaatgtaatgtatccgccgaccgtgccgccgacaagcgtcacgattgccagcacactgatatgatcaggcataaaagtttttacaaccgcgtgtccgaccggcggacccgtcgttacggcaacatacaccgtcaatacgatcatgacgattccggcgatctgcataaaacggtccatgacttttccggcttcctttatgacaaaaatcagcaccgcgaccgctgcgctgattaaagcgccgatctccggtttgattccgaataatacttgaagaccgagacccgcgccgccgatgtttccgatattaaacgcaagtccgccgagcacgaccagaaaagcaatggcataaccggcgcccggaagcaccatattggcaatctcttggccgcgctttccggaaaccgcgataatccgccatacattggtttgcgcgaaaatgtccaaaataatagaaattaaaatgataaagccgaagcttgccgccaatgtattggtaaacgtggccgtttgcgtcagaaagccgggcccgattgatgatgtcgccatcaaaaatgtcgcgcctaaaagaagcgaccatttgccggaagcctttccggctgtttttttcttttgctccatgctgtcttcctccctctgctgctcagtcttttgcaagcgcgctgatttgaatgtctgccgcttttaattcttttttgattgtttttgcgaatgtcagcgcgtgggcgccgtctccgtgaatgcagaccgtgtccgctttcaggtttacagcttgtcccttacgtgatgtcaccgtgctgtctttcaccatttgaatcacttgaccgaccgcttttttgtcatcctgaatcagcgcatccggctctgaacgcggcgtcagcgtgccgtcttcctgataggtgcggtccgcaaacacttcgcttgccgtcctcagtccgattcgatctcccgctttaatcagctcgcttccggaaagcccgaaaagaataagcccgggatcaaaatgacagaccgcctgagcgatggcttttgacaggccgggattgacggcggccatattatataaagcgccgtgcggcttcacatgctgcatctcgacaccttccgcttttaaaaaccctgacagcgcgccgatttgatacagcgtcagatcatacgcttcctcgggcgtaatcgcgatctgccgccgcccgaatccctgcagatcgaacagcccgggatgagcgccgattttcacgcctttttccgccgcaagcgcaaccgttttgcgcatcacgctgggatcacccgcatgaaagccgcaggcgatgtttgcagatgtcacataatccaaaatctcttcatccagtccgattttataagcaccgaaactctctcctaaatcacaattgatgtcaatctgaaacataagctccctcctgtattgtaaacgttttattttattatcattccgatatttggaacgactattccgaattgttggatttctcttcattatatttaattctgacaagtttgaacatccttttgtcagaaaacctaccatggacctagtcacaaatctgacaaaacaaaaaaagagagcctcatgctgagactctctcttttttctattataacacccagtggcggatcgctttggcgaccccgttttccgtgttgacatcagtcacccagtcagctgtttctttcacgatgtcctgcgcgttccccatggcgacgccgacacccgctttttcgatcatggcaatgtcattcagactgtcacccatggccatcacattttccatcgtgaagccgagtttttccgataccttcgccagcgcagccgctttgttgataccgagggcattgacttcgatgttgatcggacttgagtttgtgatttcgagctccttgtattccttgagctctttcagcacctcattccgcacttcatcatcctcgatttcgaacccgaacttgagccactgatgatccgtaatcgtttccgggaattcccctctccacactctatcgacggtagaggcccagaaattcgtgttgtgcttattcctcagatcccataatttttgaatatgatcggtatgaagaagcttgcgctcaaccagctcaaagttggaatcccagatttcgctgccgtttgccgtgattaaaaaggatgacagctcgagagactcagccagttcgcggcaggtcatcagcgtgcgtcctgtgctgatgacgacgtgaattcctttcgcctccgcttccttgatcgcccgccggttttcctccgggatgagctgctcgtcattgagcagggttccgtccatatcaatcgcgatcagtttaatatctgcgtcttctctttgtatcggcatatatgtacctcactttttatattgtagtcgtctctattttaatacatatgacccacaggaacaaaaaaccgcttcctgcgtttggcggggcgagcgttgaggaaaagaaatattgaggtgatggaggatgaaagaaagaaaacaaaagaacaaaccgaatgaaaatcctgaacatcatgatttaacggatccgattccgctggaagagctgaaggaaaacgccaatgacgaaaaacacaaacatgaccagagggacaattcacaaagtgagagagattatgatacaaaataacacgcttgtccgaaagccgccggtggaggcggctttttttacgatggctggataaatatgctgagctccgcttccgccacaggcttcccggcaacggacgctttcgcccggccgaacacaaaaccgcgtctgattcgcgtgacctcaaaaaaaagatccagacggtctcccggcaaagcggcacctaacctttccgctttcttcaccgcggataagagaccgagaccgtcaccgccggtaattcccgcgcaagccgccgtttgggccattgcttcaacgacgagcgaaaatggcatctctctttggtattcagttataaaccagtcattttcactgatgtttttgtaagcagccgcccattttccggcttcactgttcgtcgtgccgtcaatcaaaagaaacggaaaacgatggggcaatagcttctgattcatcacgcagcctcccttccctctcattataacgcaagaaaaaacccgcgtccccccgacgcgggttcatttttattgattgagctttttgagcacgatgccgtgcagcggttcatgcggctgaataccgcaaatgtcttgaagaacgccgctcgtgcctttttccgcgataagcttttgcagctcaaccgcttccggatcatcctgatagtcaaagcgcagggcggcggcgataccttccgccagcgcattcggttcttttatttttttggccggccctactaatctgtcattcgctccgagttttctgagcggtgatctggcgactcttgtcacatcatccgtgatgtattcattatcaaagcggctgatgatttttttcatgtactgctcgtgttcggcttgcttaaagccgtacgctttcaccaagtactcgcccgtttctgaaagtgcatcgtacacgacacgccggatttccggatggccgatggcctctttgacggtttttaatccgcgctgatagccgacatacgccgtgacggcatgcccggtattgacggtaaacagctttctctcaatgaaaggcgtaagatcatccgtaaacaacgcgcctttaagtaccggctgatcgccggcaaagccggttctgtctatgacccattcaaaaaacggttctacggatactttcagcggatcttcatggtgctgaatcggcacgatccgatctaccgcagaatccgggaagccgactgtccggttcacgagttcccgctccgcttccgtcaaatgtccgaaaacttcttttttcagaaaactgctgccgccgatcatattttcacaggcaatgatattgagaggctcagaggacgttctgcgcttcagaccttccgcgatggacggggcgatgagtctgagaacgttcgggcccaccgccgtcgtaatgatcgccgcttcattgatcagcccgtacagctcttgttcttgcaccgcgctgttgatggctgaaacggggccgatgatttctgtctgcctgccgccgtcggcaagctccacggtatattccttcttttcattgagaaggctgaccatcgtttcattcacatcagcgaaaactacgtcatagccggaatgatggagcagggcgccgataaagccccgcccgatgtttcccgctccgaaatgaagggcaatcatgtcagttcacctcgctgaaaatagcggccagttcttcttccgtctttgcattgatcagccgttcgatgttttcttcctctgagcagatgatggcgatgtttgacaggatgtctaagtgttcattgttttttccggcgataccgaaaacgacctttgccgtattgccttcaccgtattccacaccattcggaatctggatgacggaaatgcctgaatgaagcacctcatccttcgcatcttctgttccgtgcgggatcgcaatgaaatttcccataaacgtggatgatgtttcttcacgttcgaacattttttccacatagccgttcttcacgtaaccgttatcaatcaacgtctgtcccgccaggcggatggcatcctcttttgagttcactgtctggttcagtttgatgttcgctttagccaatacttccatgatgaagatccctctttctgtttgattagtttttaagcttttcaatcagttcatcgtatttcgggctgtttaagaaattatcaaccgaaatgtgcaccgcctgcggcagcttcgctttcgcgcggtcagtcaggtccttatgcgtaatgacgatatccgcgtcattcggaagattattgatcgacgtatttgtcacatcaatatccaggtctgcttttttcactttgtttcttaaaatggaggcgcccattgcgctcgatcccatacccgcgtcacatgcgaagataatgcggctgacttggtcagcggaaatatcagcggcgctgttttccggctcttcctctttgtctgccaatgcggccgccgcttcacttttcctgcctttcatttcctgcattttttccgccgcggctgtcaaatcttcttcgcccgctttagacgatttcagaataagcgccgagacgataaacgatacggccgcagccacgatgacgcccgccagcacgccgagatagcttcctttcggcgtcagcgccaaaatggcgatgatgcttcccggagatgatgcggcgacaagacccgcgttaaagatcgagaatgtgagcagtccgctcgctcccccggcgatcgccgcgaggatcagcatcggtttcattaaaatgtaagggaaatagatttcatgaatccccccgaagaaatgaatgatcgccgctcccggagctgtcgatcttgaagagcctttcccaaagaacatataggccagtaaaataccgagtcccggtccggggttcgcttccactaagaacagaatggattttcccgctttggcggcctgctcgattccgatcggacttaaaatgccgtggttgatcgcgttattcaggaacaggactttcgccggctctacgaaaacgcttgcaatcggcagcaaattcgcgtgaacaatgacttccacacccgccgccagcaatttgttaagagacaggacgaccgggccgatcgcataaaacgcgataatcgtcagcaccgcgccgataattcccgccgtgaagttgttgatcagcatttcaaaaccctgtctgactttatctttaaacagacggtctaattgtttaatgagataaccacccaaaggtcccataatcattgcccctaagaacatcggaatgtccgctccgacaatgactccgatggcggccgtcgctccgacgactcccccgcggtgatcatagatcatttttccgcccgtatatgcgattaaaagcggcagaagatacgtaatcatcgggcttaccaatgtattcagctgcggattcggaaaccaccccttaggtataaacagcgcggtgataattccccatgcgataaatgcgccgatattcggcatgatcataccgcttaaataactgccgaaccgctgtatcttcactttcatgccagcttgctgttcttgctgcatgttcattccctccctgtttgcctgccttcagatgaaaataaataagacacggggtttctctctcccctgtgtcttcatcataaaacgcttacaatccccattcaatgaaaagtaaagaggagtttggcacagagactgtgacaaatccttaacaaaaaaaagacacctcatcaaaggtgtcttaccgctttctgtatataatgtgtccttttgtgacgacgagcttggcaatgagccgctcactgacaataaacaccggatacgcacatacgagcgcgaaaatggcggccggcacataccgcgctgccggaaacatcggcatgacggcggttctggccatctgcacaagataaatcaaaagcaccgtgatcgcaatggccgcagccataatcggagctgatactttatattcacgcaatttcacatggcaatgcccgcactgaaactggcacgggatcatcgatgatctgaccatgtcgcctgtaatcggcttgccgcagttcgggcaggtcgtttctttcatgtttattcctccattcaactcttctattataacagagtctgactgcgtgttttacatttgtgattgttcaacattttttcacatattttatcatcaggctcttgtgtgcatttgtgaaaacatctactcttagagggaggttcatcactcattcgcataaaaaggaggatgcagaattgcttccgattcacagacagcaaaccttgcttgaatggctgaaagaagagggcgcgctgaaaatctctgacataagcgagagattcggcgtctccgagatgaccgtgtacagagacgtcaatcagctggcggatgcaaaccggattatccggacacccggcggcattacgctccctcccgcttcagaacgaagcgccaatcaatgcggctattgcctgcggccgattcagcattcgtattctgttcagcttattaccgtttcacaaaccgttgagcagatgtgctgcattcattgcgcgattttgcggtatgaggataaaaaggatgaagtgtcccacgtcatttgtaaggattttcttcttcagacgacgctaacggcagcttccgcatactttttagtccatgccgatattgaccttcactgctgccggcctcaggcgattcccttctcaacgcttgattacgcagaacggtttcaaaaaggattcggcggggtcatttgcacctttgacgaggcggcggacatcatcttacacgacaggcagaagggatgcacctgcagcaagacataacaacaaccaaccggaaggcggtgtcatcatccatgagacagaacaaacgctggctcgtctttttgctgttccttgttttgattccgaaaacaagcttcgcccacgcctacatcacaaactcaaatccgggtgagaacagcgaattaaaacaagcgccgaagcagattgaaattgagtttaatgaacagattgaagaaggcttccactccattaaggtctataattcatccggtgaacgggttgacgcgggcaaaacggtgattcaaaaaaataatgcccgcatcatgaccgcggcattgaaaaaaaatctgccgcatgatatttacagagcggaatggaacgcggtatcggccgacggacatccggtatccggcgtcatccctttcagcatcggaaaagccggcggagaacttcaggagcagacatcatcgcaagcggcgcttcatcccgaagcggccatcgaccgcggtattttgtacaccgctctctccctgtttatcggcacggcttttttccatctgttttggtacagaaataatgaagattcatcaaaagcaaaacgaactgtaaagctgctcgtgatttctttatgtttaacggggctcgcgctcgtgtgccagctcccgatccagacgaaagaaaacgcgggcggcgcttggagcgccgcgtttcagccggactatgtaaaagaaacgcttctgaaaacggcaggcgggtacgtctggatgatccagatcagcttatttatcctgctcgccctgtccatgatcccgctgctgaagaagaaagcattccggtcatttgcgtactggacggcgccgctgttattcttcttcgcttcgcttttggcaaaagcattcgccgggcatgcggccgttatcgacgaaaaagcggtcggcatcgcaatggactttctccatttatcggccgcgtctgtatggatgggcggtatcgccgcgcttgtgctgcttctttcatcagagtggagagaacccgataaaaccatcgcttgggaaacggtcagacggttttctccttgggcgttcgcctctgtcggcgtgctgttattttcaggagtgctgaatggatttttcattatccgctcgttcgattcactctttcacaccgcttacggcaagacgctccttttgaaaatcggactgtttgtcatcatgcttgcgctcggcgccgttcacgtatggatgacgaagttcagcagaaaaaggagcatcagcgcaacgataaaggccgaatgggcactaggcattgcggtgttattcacaaccgccgtcttcacaagcctgcccagtccgcctccgcccgcgccattgccttttaacggctcagaaacgatcggaaacggggaaaccctatccttgcacattacgccgaaccagccgggtaaaaatgaatttcaagtcattgtcaccgatcataacggcagcttagtaaaagacattcagcaatttacggtcactgtttaccagacgggcttcagcggcaaacagcatgaaagcacctttgatttgaagaagacgaaggaaggcacattcgaagccgccaacctgtccatcaccgaaaagggaaactggaagatcaaagtccacggactgacaaacgattttaatgaaatcaaccaaatattctcaacgacaaactaaggagtgtatctcatgttgaaaaaaaaagctttaatattcatatccgccgtgaccctgtcactcgtcggttttacggctgcagcaagcgcccacgtctcagtcaaacccgcggaatccgcggccggttcttgggaaacgtacacgatgaaagtgcctgtggaaaagaatgagccgacaacgaaagtcgtgctgaaaatgcccgccggcgttgaatttcagcagtatcagccgattccgggctggaaaacatccgtatccaaacatgatgacaaagcggtctccgtcacttgggaagcaaaggacggcggcattcagcccggccaattccagcagttcacgttcgttgcgaaaaatcctgaaaagagcggagatgccgcttgggacgcttaccaatattacaaagacggcagcattgtagaatggacgggtgatgagaaagccgacacgcctcactcgattacgaaaataacgaaatcggcgagcgtgacggatgcgcacggagctgaacagtcaaacgaagaaagcaaatccggcgtatcagcgcttgatattgcggccatcgttctgtcagctgcggcaattatcctttccatcgcggcgcttgtaaagaaaaaacgtgtgtaagcaaaaagcgatccggctctaaagagcctgcgatcgctttttttcttatccgcggcctgcctggaaagacggatatttggtcattcccccgtcagcaaacagcgtaatcccggtcacatagcttgattcctttgaagcaagccagacggcgacagccgcgatttcttccggctcaccgatatatcccatcggaatcatgctttccacatcttttttctgaacgggatcggcaaatttttccgcgttgatcggcgtattgatggcgcccggcccgatgttgttgacacggatgcgcttcggcgcgtactcaagcgccagcgtttccgtcatcaatttgatgccgcctttactcgccgcgtagtggacaaacagcggccacggaatcatctcatgtacgcttgacatgttaatgacgtttccttgaatatcattctctacgtaatatttaatggcttcgcggcttcctaagaaagcgccggtcagattggtattgataactttgttccagtctttaagcggcatttcatgcgactgaaccggattttccatgccggcgttattgatcatgacatccaatgtgccgaattccttcactgcggtctgcacgatgtttttgacatcttcttcttttgtgacgtctccttgaacgatgaccgcttcgcctcccgctttttgaatctcttctttaacggtttgggcgtctttttcattactatagtagttaaccacgactttcgcctgctcctgtccgaagcggatcgccatcgcttttcctaatcctgatgaagctcccgtaatggcaacgacttttccttttaaatccgtgtacatgttcaaacctcctgcatatgttatgaatttgatttcgcaacgcctaagaataccgcggctacaatgatcaggataatcccgatggcaatggcgaccagctgacgcttcgttttgctctcacggagaatgaagattccgccgagcgtgctgatgacgatccccatttgagagagggaaaaacttgtcgcaactccgacgcgcggctgtgagatgaacagaaacatgttcccgagcgcccagatgattcccggcagaatgttcttgagggcgtacttattaaacggtttatgcttgtacgtcaggagcagtccgccgatgaccatcccgatcgcctgcggcagaagcgctgaccatccggatacaccgaacagccgggcgacgacgacatagaccaaatagccgagcgtggagatcagcaggatgacaatgcctttttttaagtttcccggttctccgtccgcccgcccctttttatcttctaaagatgtgagcacaatcccgatgatgataaaaataagggcgagaatacccagcgtaatcgcgatcggggttgaccattctttgaatacgatcacaccgaacaaagaagtcgagacgagctgcattcccgttgatatcggcatcgtttttgaaacgcccatcagctgtatgcttttaagctgattgctttggccgagcgaccaaaacagccccgagatgatgccgacaataaaaatgcgcccggacagcaccggatggacaaacagatacagcacaaacgaaacgatgagcgccccgattgtcgttcccagcgtctggctgtaaggcccgccgcctaatttgacgttaaataacacgatgctcccccaaaataaagccgggagaagagccagtaatatatccatgatggcgaccttctttcaatcgtatttgctgttattttgtctggaatcgaaccgattattcccgcaagatcaaaaaagcctgccggcgatattcaccggcagaccgctcaataaaaaagccccgcttagaagcggggctttcttttcggctcattaaagtccgatagacatgtatttggtttccaggtacggttcaatgccttccgtaccgccttcacggccgatgccgctttctttcattcctccgaacggcgcttgaaccgcggacggaccgccgtcattccagccgatgataccgtattcaagctgttcagaaatatagatgccgcggcggtagttttctgtgaagaaataagccgcaagcccgaacggcgtatcgttcgcaagcttgatcgcttcatcaatatctgagaacgtaacgatcggcgcaaccgggccgaatgtttcttcatgcatgatgttcatggatgtatctacatttgaaagcacggtcggcgtcacgaaatagcatcctttttcgtcgttttggtcatacgttccgcccgtcagcacttctgcacctttttccacggcgtcattaatttgcccgacgattttatcgaagccttttttgttgatgacagggccgacgtttacgcctttttcaagaccgtttccgactttgagtttcgcagcttcttcactcagttttttcgcaaactcgtctttcacggattcgtgtacgatcagccggttcgcacagacgcaggtttggccggcatttctgaatttagaggccattgtttgggctaccgccagatcaagatcagcgtcttcatccacgatcagcggcgcatgtccgccaagctccattgacatatgttttacggtgtcggcgctgtttttcatcaggattttgccgacaggcgttgagccggtaaaggtaattttacggattttcgggctgctggtgaagacgtttccgatttcggctccgtcaccgatcaccacttgcagcacgtccttcggaattcccgcttcatatgcgagacgcgcaagggcgtaagcggaaagcggcgtatcctccgccggtttgatgatgaacgtacagcctgccgccaaagcgggcgcggcttttcttgtaatcatcgcattcgggaaattccacggcgtgatcgcggctaccgggccgaccgcctgacgggtgacgacaatccgtttgcccgttgtcggcgcaggtacggttctgccgtaaatccgttttgcttcttcggcgaaccattcaatatagccggcgccgtataaaacttctccgaccgcttcttcgtacggtttgccgttttctttcgtaattaattccgcaagttcttctttattttcaacaatcagctcataccattttctcaaaagtgaggcacgttctcccgctgatgttttggaccatgattgaaacgcttgatgtgaacgttcaatcgctttttcaacatcttcggccgtctgctgggggatgctttcgatcgcctctcccgttgccgggttgtacactgttaattgttctggcatattgaacattcctttctttcctatagtaaaaccattgaatgcttgttgatgtatctcacactttcatgatagcagacacatccggcgggattccaataattgaactcacagagctgcttcgataatggaaaggccttctttgagctgctcatccgtcacgacaagcggcgtcaggaatcggataatgttgccgttaatgccggccgtcagcagcagcagtccgttctcgttcgccgttttagcgatcgccgcggcttttgctttgtccggttcccgcgtgtacggatctttgacaatttcgatggccgccatcgcgccgagtctgcgcacttctccgatgcaggcatgctcttttttccactcgatcgcttgatgctcgatgatccggccgatctcttcggaacgctgattcagcccttcttcttcaataatatccaagaccgcgagcgcagccgcacagccgagcgggcttcccgcatatgtgccaccgagttcccccggcgcggcggcatcaagcatttccgcccggccgatgacaccgctcagaggcaatccggccgcaagtgatttggatacggtgatcaaatccggaacggcttcgaaatgctcaatcgcaaaatacgttcccgttctggcaaaaccggtctgaatctcatccgctacaaaaacgataccgtgttttttacaaaaagcggcgacgtgctgcacgaaacgttttgaaggaatgatgaagccgccttctccctgaaccggctccattacgacacaggcgacggtttccggtgcgactgcggcgataaagaaatcctcaaaagcgctgatgataaagtcgtcatactgctcgtcgctcatgccggccggcttttgataatagtaaggaaacggcgcttgatacacctctgaggcaaacgggccgaaaccgtatttataaggcttcaccttgctcgtcatgctcatcgtcatgttcgtgcggccgtggaaccctcttgtaaatgacacgacagcctggcgcttcgtatattttctggcgattttcacggcgttttccaccgcttccgcccccgaattgagaaaaatcgcttttttcgcatgatctcccggcgcaagggcgcaaagtttttcggccagctcaatataagacggatacatcatgacgttaaatcccgggtgaatcagatcctccgcctgtttcttcacggcctccaccactttcggatgagaatggccgacattcagcgttccgatcgctccggcaaaatcaatgaatcgtctgccgtccaaatcgtacaaaagcgccccttccccttttaccgccatgctgcggtttccgttgccgacccccttggaaacgaattggtcccgtttttgctgccactgggcagttgtcacttccgatgatgctgttcgactcatagattccatccccctatattgttttcttatcattctgacttctttttggtatgatgaaaagtaccaaaatcaatttatccatggtatcagaaaggagcagggtctggatgctgacgatttccattaatcattcggaaacggcggattatatctatcagcagatctatcagcacataaaagcggccgttttgaaacgcagcctgatgcctcatacaaaggtgccgtctaaacgggagcttgccgagacgctgaaggtcagcgtgaattcagtgaattcagcttatcagcagctgctttcggaaggttatttatatgcagtcgaaagaaaaggctttttcgtggaggaaattgatacggtttatcatgaagaaacgccttcgctctcattgcctgaagatttaaaagagcgggagccggataagagcggctggatttcgttttctcatatgagcgtggatacggcgcattttcccctgaaaagctggttccgctgtgagcataaagcagccgcccgttcatttcatacactcggggaactcgtccatccgcaaggcttatatgaagtccgtgaaaccatttcgcggcttatttccctgacaaggggcgttacatgccgcccggaacaaatcgtgctcggggcgggcacgcaaatgctgacgcagctgctgacggaactgctgccaaaagacgcgctgtacgccatggagaacccgggatatatgaggatgtaccggctgctgcaaaacctcgggaaaaaggttgcgacgatcagccttgatgaaaaaggcatgtccatggccgaaatcgaaaaacgccggccctgtgtattgatcaccacgccttcccatcaattcccctcaggcgtgatcatgcccgcttcccggcggattcagcttttaaactgggccgccgaacagaacggccgcttcatcattgaagatgattatgacagtgaatttaaatatgacgccgatacgataccggcgcttcaaagccttgaccggtttcaaaatgtcatctacatggggaccttttcaaaatcccttttcccaggtctgcgcatcagctatatggttctgccgcccgggcttttgcggacgttcaaagagagagcgtatgacctgcatacgtgcagcacgcttgcccagctcgcgctgaaagaatttatcgactcaggtgaatatcagaaacatattaaaaagatgaagcagcattataagaacatgcgggaacgcctcatttcggctttagaagaaatattcggagaaagaatcagtgtaaagggcgccaatgcggggcttcattttgtcactgagtttgactgcgcccgttcagaaaaagagattttggcacgggcggatgcagaacagctcgatctgtttgcgatgagccggttccgtctgaaagcaggaggcgattcaaataagccgcagctcattctggggttcgcccgcctgaaggagagcgatattcaagatggcgtcctcaggctttaccgggcggttttcgacgcataaaaaaacccccggaattcggggacttatttaccagcggtccggttctgtctgcaaaatcgcctccagcaggccgggaaacgccgcttgtaaatcatctttgcgcagggaataataacggtgcttcccgtctatgcgcacttgggcgatccccgcttcccgcagcactttgaagtgatgggacagcgttgatttggcgacccggacatcagcgcaggtaccgcacgttttttctgttgtttccgccaattgtttgaccagctctaagcggagcggatcactcagagcatgaagaacctttgtcagctgtaagcggtcggtttcaggatggtttggaatgttcatgagtcaaatgtaacacataaaagcggcgggtgacaatttaggcggtgagggtttttcctttaccattcactgcgaaacatgttacagttagttcgataatattcgaactataacaaataaacccaatcaggaggaataacaatgatcgtcttacaggcttacatgaaagtaaaagcggataaacgcgaggaatttttaggagaagcacaatcacttgttcagcattcacgcgcggaagaaggaaatgtgcaatacgatcttttcgaaaaagtcggtgaggaaaatacattcgttatgcttgagcaatggaaagatgaagaagcgatgaaattccacaacgcaactgaccatttccaaggattcgtggcaaaagcaaaagaagtgctgagtgcgccgcttgacgtcgtccgcacagaactgtcagagtaacgaaaggatgaatgacatgaacgaagtccttcaaatattaacagaccaccgttccattcgcagctacacagatgaacccgtatcggatgagcagctggaccttatcatccaagcaactcaggcagcgccgacttccattaacggccagcaatttaccgttattgcggtgaaagataaggagcggaagaaaaaaatatccgaattggccggcggccagccgtggattgaccaagcgcctgttttccttttattctgcgctgattttaaccgcgccaaaattgcgcttgaagaatataatgatacaccgcttgagatcacgaacggtttagagtccgttctagtcggagccgtagatgtcgggattgcgctgggtacggcaacggctgcggctgaatcaatgggactcggcactgtgccgatcggcgccgtgcgcggcaagcctgacgaaatcattgaattgctgaaacttccgaaatacgttttcccgatttccggtctcgtcatcggccatccggcagaccgctccgcgaaaaaaccgcgtctgccgcaagcagccgttctgcatcatgaaacgtatcaagaagaagatttaagaacccatatcgaggcctatgacaagcagatgtccgaatacatgaaaaaacgcaccgacggacaggaaacaagaaactggtcacaaggcatcacttcctactataagcaggtttattatcctcacattcgtgaaatgcttgaaaaacaaggatttaagacggataaataaacgtatcagcctgtcggaacactccggcaggttttttctatttctcaaacaaaagcgttgacactatgtaaaaatttttgttaatattttcatcatatactcattggttttctgtgaaccgatgggttttctattgtgacgaaagaaggaatctgggcttatgaatgataagaaaacggatattctgctggcggcaaggaagcttttttccgggaaaagcttttcgtcggtctcgatgcaggcgatcgcagaggagtgcaaagtctccaaagcatctttgtataagctgtttgaatcaaaggaagacctgctcctggagctgctcgattttaaccagaaacagatggtagcggccgcttcattattaaatgaagaaacgagcctctcccctgaggaacggtttgccaaaaaactgatggctgagcttgaaggcttcaggcgcaaccagcagttttttaatatgctgatgtacggaagcccctcttccattaatgagcgggtaaaacggcatattcacagggcccgctccacctttatctgctggcatcgcgattcactgattcagacgtacggcgaagacattattccttatgtatgggagctggtgatcgtcctgcaggggctcctgagagaatgcatcacgctgattaagctggaaaaagaaccgctcgccctggagccgctcacggactttatcatccgccatctcaatctcatcgtcgaaaacaggaaaaccgaaacggctttgcctcaggagatgattgacctttataccgcctccgcttcctcatttgagccaaaagacaaaaccgtattgctggctgaaagcctgaaggaactgaaagaagccgtctcagcccttccggaggaaaaatatgatgccgcaggactcgcttccgcggcggttatgctggagaaagaatcagcggacaaacagccgcgggattttcttataaaagcgctcatcggttatttggagcaggccggaccgctgcaccagccgcttgcagccgttaaaacattgctcaaactataaagaaagaaggaatcagcttgaataagagtattaaaactgcaccatacaaccgctctgtcattgtcgggattcttttggcgggagcgttcgtcgccattttgaaccagacactgcttatcacggcgctgccgcacattatgaatgacttcaatatagatgccaacaaagcgcaatggctgacaacgtcgtttatgctgacaaacgggattttgattccgattaccgcatttttaatagagaaatttacgagccgcaccctcctgatttccgctatgagtattttcacggtgggcaccattgtcggcgcattcgccccgaactttccggtgctcttaacggcccggattattcaggcggccggcgccggaattatgctgccgctcatgcagacggtatttctcacgattttcccgatggaaaagcgcggccgcgccatgggtatggtcggcttggttatttcgttcgcgccggcgatcggcccgacgctttccggatgggcggtcgaagcattctcttggcggtctttgttttatatcatcttcccgatcgcagtcatcgatttgcttttagcgattattctgatgaaaaacgtcacgacattacgagaaacacagattgatattttatccgtgatcttatcgaccctcggattcggcgggctgctttacggcttctcaagcgccggttcctcaggatggaccagtactgaagtgctgacttcgctgcttgtcggagcggccgcgctgattttctttatcgcaagacagatgaagctcaaaaaaccgatgctggaattccgtgtgttttctttcgggattttcagcctgaccaccctgctcggaacgcttgttttcgcgctgctgatcggaacggaaaccattctcccgctttacacgcaaaaagtccggggcgtctccgcgtttgataccggattaatgcttttgccgggcgcgattgtgatggggatgatgtctccgtttatcggccgggtgtttgacagaatcggcggaaaaggccttgcgatgaccggattcttcatcatcctgctcacgtccctgccgtttatgaatctgacggactcgacgtctctcatttggattgtcgtcgtttataccgcacggcttttgggaacagccatgattatgatgccggtgacgacagcgggaatcaacgccctgccgcgccacttaattccgcacggcacagccatgaacaataccgtccgccaagtcggcggttctatcggtacggcgctgctggtttccgtgatgagcagccaggccgcgcacgccaatgcgtcaactccggcaaacgccgccctgcacggcatgaatgcggcctttgtcgtagccgcctgcatcgcgctggccggcttcctcctatcttttacattgaagaaaaaaccgcgtcagcccgagcagcagcaggccgttacgcggtaaaccaaaaagaacccgatcacgtatgtgaccgggttctttttttacttctcgattccgtcttttacttctttcaccatttgcgccatggattccaggccgcctcctgataaataccatgtagctgaatcaaggtagacaacatggttgtttttcacggctttcaccgattttacataatcattttcaaccacttgttttgttgaagattttgtgccgatcgctgttccgcggtcaacgacaaacatgtaatcagggtttgttttggcgatatattcataggaaatgctttgtccgtgcagtgaggcttcgatgtttttgtcagccggtttgacgccgaacacatcatgaatgaagccgtatcttgatttagacccgaacgcgctgattttgccgtcgttcgccatcaccactaatccgtttttatccgtgctgcttgtctttttcttcagatcggcaatggatttgtcaattttcgcaagcttatctttcacttcattttctttgttaaagattttgccgatcacttcggtgttttgcttgaatctgtcaacgtagtttgtatagtcatcatcaagataaatcgtcggcgcgatttttgagaactctttataagaatcagattgtctgtgggcgataatgattaaatccggatcaatatccgcgactttttcaaaatccggttcttttaaaccgccggtattggcgtatttatcactattatatgaagataagtattttggaaggttttgtttcggaagtcccgccacgtgatcctgtaaaccgagttcatccatcgtatccagcattccgaagttgaatacgacgacttttttcggattcttcggcactttgactccttctttgttcagatcatctttgattgtgattgtttcttttgatttgcctgatgttttgtccccgtttccgcatgcagaaacaacaaaaatcgtaactagcgcaatgaatagcaatgcgaattttttcatgactttcacctcatctggtttttaagaaaagtacacaccgatccgctgactgtcaatctcttgaatcgggatggtcatatcataaatatcttcaagcacggaggtttcaatgatctcttccgccggcccttctttgacgatccgtccgtttttcagtgcgacgatatggtctgaatatacggatgcgaagttgatatcgtgaatcactacgacgaccgtttttccgaagtcttccacaagccgcttcaacagcttcatcatttcaacggaatgcttcatatctaaattgttcagcggctcatcgagaaaaatatagtccgtatcctgagcgatgatcatcgcgataaacgccctctgacactggcctccgctgagctgatcgaggtatttatcctttaagtcatccagcttcatataactgagggcctggttgatatgcacccaatcttcatccgtcagtttcccttgggaatacggaaatctgccgaagctgaccaggtctttaatcgtcagtctgatattgatttggttcgtctgcttcaggatgctgatttttttcgccagatcgttgcttttacaggccccgatctcttgcccgtcgaccgtgatttctccggaatccgtcttaatcagccggctcatgatagacagcagcgtgctttttcccgcgccgttcggaccgataaacgaggtgagcctgcccttttgaatggatagagacgttttctcaaggacggttttccctccgtattgtttgcttacatttttgacctctaccatgatttattctcctttaacagcagatagataaaataaatcccgccggcaaaattaatgatgacgctcagcgtcgtggaaaacgtgaacactttctccacgacgaactggcccccgacgagcgcgacgatgctgatcaggacggaacccgcgattaaatacgtgtgcctgtaggtttttaaaaactctctcgccagattgacgacaagcagtcctaaaaacataatcggcccgacaagagccgtagagacagacacaagaatggcgacgacgatgagcatctgtttcacaagcttatcgtaatcaatcccaaggttgacggcgtgctccctgccgagcgacagcacgtcaaaaaaccgcgtgaaccgccagacataaatgcctgtcagaagaaagacagcaccggcaaatcctaaaagatcggtgttgatattgttaaagctggcaaacattttgtcctgaacaacctggaactcattcggatcaatcagcatctgcataaaggatgacagactgttgaacagcgtgccgaacacgacaccgacaagcagaaggaaaaacacgttccgcccctcgcctttaaacatgagctgatacaaaacgagtgacaagagcaccatcagcccgacggagatgacgaaattaagatttttgttcatcatgacgatattcattgaaccgaacaggaacacgatgacggtctgaatgagcatatacagggaatcgaggcctaaaatgcccggtgtcagtatgcggttatttgtaatcgtctggaagatgaccgttgaaaacgcgatcgctccccctgtgagcatcatggcaagcactttgaagcatcgtctcggcagggagtattcccaattgcccagtccgtagaacagaaagaatccgatacatattatggcgagcgccgccagcagcgtaatttttttattatgactcatatgcttttctccttaacagcatatacaggaagatgccgctgccgataacaccgaccatcaggccgatggaaatttcgtacgggaagatgatcacccttcccaaaatgtcgcaaaacagcacaaaaacagcgcccaagagagcggtgtgaggcaggctgctcctcaggttgtcccctttgtaaatcgacaccatattgggaatgatcaaaccgagaaacggcagcatcccgacggtcaggatcaccagtgaagcgatgagcgacacgataatcagaccgatattgacgacgcgtttgtatttcaggccgagattgacggaaaagctctctcccattcccgccaccgtaaatttatccgcatacacataagcgatgatcaccagcgggatactcagatataaaagctcataccggcctttaacgaccagtgagaaatctccctgcagccaagatgacaggttttggatcaggtcgtatttatatgcgataaacgtggcgattgagctgacgatgttcccaagcattaaaccgacgagaggaataaaaatcgcatcattgaacttgattctctcgaggattttcatgaaaaggaaatttcccgccaacgcgaaaataaaagcgatagacattttcacaagcgggctcgctgacgtaaaaagcattaatgaaatcaaaattccgagccttgcccagtccatcgttcccgcagtcgtcggcgatacaaatttattccggctgatctgctgcatgattaatccgcagatgctcaggctcatgccggcgatgataatgctcaccaaacgcggcagccggctgtcaaacaatgtacctgcctgttctttatttaaatgaaaaatatccagcggcgacaaatcttctacaccgataaatatagaagtacacgccaaaaccgccagtagcaaaagtaagtaacgtagcttcatgctgcctccctgcacccatcacaaacggtatgactgattgccaaacaactcccatatatccccactcgtaatgattatcattatcaacgacaactataatcttatcatctttccaagcgcagtcaatacagttttgctttcaaaaacggtcatccgcgggccgtacactaaattgtcttacaatcagtctatcaagaatttgcaggattttctataaccttcatttggctgcttatcattttttgcacatgatgacacgcttgcgggaaacaaatctgacaaacagcggcaaaattcctccacgaaaatacaaatgttctccccacatagaaaaaatccttgatttacatgtttgaaagagagataataaaaattaaatttgtgagaaaatttaaatattaggggatgtaaatcatgaaagttgtaaaattcggaggcagctctcttgcgtcaggagcccagcttgagaaagtgtttcaaatcgtgacggctgatccctcgcggaaagccgtcgtcgtatcggcgccgggaaaacgcttctcggacgatacaaaggtgacggatctgttaatccgctgtgcggagcattatttgcaaaatggtgcagcgcccgagcttgccgaaccggtcattgaacggtacgccgccatcgcgcgtgagctgaacctggatttctctattatagaaagaatccgcagtgacctattcgctctcttaaacagcagcaaagccaatcccgatcagtatatggatgcggtgaaagcgagcggcgaggacaacaacgcgaagctgatcgcggcctacttccgccggcagggcgtgaaagccgaatacgtaagcccgaaagaagcggggctgtttgtgacgaatgaacccggaagcgctcaggtgctccctgagtcttatgatcatttgtaccgtctgagaaaccgtgaaggcttgatcatttttccgggatttttcggttacacgaaggagcatgagattgtgacgttttcccggagcggttctgatattaccggctccattctcgccagcggcttaaaagccgacctgtacgaaaactttactgatgtggacgccgtctattccgtcaacccgtcaatcgtgcggcatccgaaagagattaacgaactgacgtatcgggaaatgcgtgagctctcctatgccgggttttccgtttttcatgatgaagcgctgattcccgcttttcgggccggcatccccgttcagattaagaatacgaataatccggaggcgaaaggaacgcgcgtcgtcagcagccgtgacaatacgaacgggccagtcatcggcatcgcaagcgacacgggcttttgcagcatttacataagcaaatatttaatgaaccgggaaatcggtttcggccgcaaagcccttcacattttggaggaagaaggattgacgtatgaacatgttccatccggcattgacgacatcacgatcatccttcggcacgatcagatggactcagaactggaacacaggctcgtcacccgtctgaagcaggaacttcaagcagatgaagtcacagtcaggcacaatctggcgctgattatggtcgtcggggaagcgatgcgccataatgtcggcacaaccgccagggcatccaaagcactgtccgaagccggcgtcaacatcgagatgatcaatcaggggtcatcggaagtcagcatgatgttcggggtgaaagaagaacaggaaaaacaagcggtgcgggcgctgtatgacgagtttttcgccggagtcttactcccataggacaccgcctcttttttctcttgtccactaatatcccttacaaagcagcttcttttacatattgtatggtatagacaatatggaggtgaagctcatgtcaggatattctggaatcagctctttcgctttgatcgttgttttatttatcctgttggttattgtaggtactgcctatgttggcggtttctaagcatcactccgtctatatgaggacgctgcgggttttgacctgcggcgttttcttttgttttccgccgctgtccaagtccggccgcgcaaaaaaaagactgccgggaacattcccgggcagtcttttcctttgttcaggttattttcttctcacgtcattcctctttcagctacatggaattcagcctgatctgtctggcctgcacctgtcactgtaaaaatcgcggcggctgctaaacaaataacaaaccatttagatttcaatttcatacaaaccctcactcctttgtatttgtttccttgcctcttcgactttcagaaaatagtcagaagaaatcttaaagcaattttgttcatagtaatatttagctgcttctagtgctaaatcctctatatcggcgtataaatttttatcttccaggtaacggaaacacgcgctgattgtttcctcatccggtttcgcctgatacagagcctgcagccattcgaattttaccgtgtaaacgggatcgtctgtttctttagcatattcatatccccgcttgtgatattccgacgctttttctttttttccgagtttaaagtaaatgagtgtgattaggaaatatgcttgaggaagagaattgacgattctttgtgattcaaatgtatcaaccgcccgttcaaagtacggaatcgcttcgccgatgcggtcctgattgtagtagcacagtccgaggttatacagcgccctcccgacaagctgcgctttttgttctttttcggccatttgcaaagcgtgctgaaaatgtttggccgcctgttcaaagcgcctttcatccattaaattgacgccgaatacaaaatggcattgaatgatcctgacgttatatgtgtcctgctctacgtaaatttcataagcgttttttatatgtatcaaagaaaaatacgtttgtttcatatgataataagcttcggccactttaaaataaaactccgcccgttccacgtggtccgatacgaaggccagttttttctcagcttgtttataatacgtaatcgctgagataaattctcttttatcaaattcaaacatgcctttgaaaaagttgacgtaataatcgagaagccctttgaggccggcctggctgttatcaatgttatcaagaatttccgacagggtcggctggtcttctatcttcagtttttccagcggctccaagtagtccagcatcagctgatggcgaaattccatgagggaataataaagcactaagtttgaatcaggctccatacggtcaagctcttgtttgatctcggccttcaagatctccgcatccggcacgctgaatgttctgatgtatcgataccactcgttaattttctgcccgactgctgaagaaggaattaacccgctcttcattccttcaccctccccatccaagacctgtttaccagttattttatcacgtttccgtgtctttccatcccgaaaaacacgcaaactttgtttcggcagagcgcaattttccgagtgaagataaaacagccggtagccagacgggactgccggtttcaagatgattcatgtatcgtattcagcggaaggcggattgtaaacgtcgtgccttttcctttttcgctggcaatatctatcgtgcccttgtgcatttcaacgagctgcctgacgatggacaggccgagtccgtattcgccgtatgccgtattcgtccgggacacgtccgccttataaaaccgctcccatatatgctcaatttcctctttggagatgccgattccggtgtcttcgatctcaatcaccgtttctttatagccttcatacccgcgcagcgtgatgtctccgttttgcgtaaattgaatgctgtttttcgtgatgttgacgagaatctggatcagcctgtcataatcggcgaacactttgacgccgtcctccgcctgaatccgcagctgattttgtttttcctccgcctgctgattgagatgctctttaataatttcaaacacctcgatgagcggcagactgagcttgtccagtttgatttgctgggatctgattttttcataatccagattttctttcacgagcctgagcatccgcttcgtttcttcactgatcagcgagaagcatttctctttatctttttccgggatggtgttgctgttaagcccctccacaagtccgttaatggtcgtcaaaggcgttctcagctcatgggagacatcggcgataaattggcgcctccgtttttccaggcggtcaatctgctctctcgattgcttcagatttttggccatgatgttgaaatcggacgccagcatgccgatttcatcgccgccgctgttcttgagcgaaatatcgtaatccccggatgccacttttccggtcgcatcccgcaatgtctgaatccgcttaacgtgaaatttagataaaagccagctcagcagaatcgtgatgataagggtgctgataatcgcgtaaatcatatagcggttgacctggctgatcatctgctcgacccctctgacgggagacacgagcagcaccgcgcctttaaattgatcgttgatcaaaagcggttttgcgacaagcgatacttccaagccctccgtattaaaacggttcatctccgctctgatctgaacggttttcccttgcttcagcatgtgccactctttacttttgagcttctcgcgcggcggcatatcgtcaggaaaaaagtaaggccgctgatgttcatcaaaaataataaacctggtctcgcgcgtttttaacatgtcctgatacggatacaggcggcgcagatcaagatcgcgtccgttcagctcacttgtgatctgctgggcgtaagaagacagctcatccactttattttgatacgcaaaatctttcacaaagtgcgaaaacagggaaatgataatgaaaaaggccaaaatcaaaatgctgacatggcttaacagcagctgatataagtatttaatcctcatcaaatttgtatcctaccccccacaccgtgtataaaaacggtttttcctcactggacagttttttgcgcagccgtttaatatgaacatcaaccgtacgttcatcgccgtaaaattgatagccccacacctgctcaagcagctgctctctcgaaaagacctggcgcggattttgtgcgagataaaagagcagatcgaattccttcggcgtcagattctcgacaggctttccatgcagaaacacttcccgcgtcttcttattgattgaaaaacacgccgtttcgatcaagtcgccgctttttacggcctgccccgtcgcccggtatcttctgatcaccgctttaatccgcgctactagcgtcagcgggctgaacggcttggtgacatagtcgtcggctcccatttcaaacccgatcacctgatcagactccgtgtcctttgcggtcagcataataatcggcacactgctcgtctctcttattttccggcagatcgtcactccgtccatagatggaagcataatatccagaatgaccaaatcccagtcctcttccgtgaaccgctgatagccttccactccgtcatggacaaattcggcttcaaatccttctttaaaaaagaacatttccgtcatggtgcatacgcttatattgtcttctatcattaatatcttcattgggtcctccgtttatcttgacgcttttacttataatagcaccattttacccggatattttcgcgtttcacaattgttagtttttatttcatcacccggaaatagtttgttcatatttttttcatacatttctcctactatatacatatcggataaccggttctaaagaaggctggttttacaagatctgacacccacacggaggaacagacatgaactttataaaaagagccttttggagcatgaaggcaaaaaagggaaaaacgtttttgcagctggttgtgttttcagtgatttgcatttttgtcctgtccggtcttacgatccagtcagcggcaaagaaatcaagcgaactggcaaggcagcagctcggcgggagcgtcacactccaggctgaccgccaaaagcaaatggcgcagcagcaaaaagacggtgaaaagaggacgtttgaatcaacgccgatttccgtctcggatgccaagaaacttacatctttacagcacgttaaaaattacaacttcctcacgacagcgtcagcaaacgcagaaagctttgacgcgataaaaagctcagacgaatcagccgataacagttccggcggaagccgttttcaaggcggcggaagacagatgatttcagcggatatttcggtcgaaggcgtgctctctacggcgctgcttgatgatttcacaggcgggagctcaaaaatcactgatggccgcgccatcacaaaaacagatgcggacgcaaaagtcgcagtgatcaatgaaacgctggcagatcaaaacaagctgaaggtcggcggctccattacagtttcctcagcagcggatgattctgtgagtacaaagcttaaaattgtgggaatttataaaacaacatcatcaggagacgatcaggcagagcatttttcattcttaaaccctgacaataaaatctatacgccttacaccgcagctgcggcgttaaaagggtctgataacaaaaacagaatcagctcagccgtttattatatggatgatgcaaaatatattgactcattcgttgcggctgcgaaaaaaacatctatagatgataaaacctacacgctgacgacaaatgatcaggtgtatcagcaaatggccggcccgattgaaaatgtcgcgtcattttctaaaaacgtggtgtaccttgtatccatcgcgggcgcggtcattctcggattgatcgtgatgatgtcgatcagggaacgcaagtatgaaatgggtgtcttgatggcgatcggcgaaaagcgctggaagctcatcggacaattcttaacggaaattctgattgtcgcggttatcgccatcgggatcgcatccgtcacgggcagccttgtggcgaatcagctcggaaatcagcttctttcccagcaggtcagctcagccgatgattcccagcagcaaacaagcggctggggcggaggagaaatgccgcggggagacggcatgttcggtcagcattcatccggtgcagatgtcatcagtacaatgcaggtaaacgtttcgctgaatgaccttctgattctcggcgggatcggcgtcgcaattgccgtcatcgccacattactgccgtctgtatcagtcatgcggcttcaccctaaaacgatcctgaccaagcaggaataagaggaggcagcataatgagcctattaacctttcaacagatcggctactggtaccaagataaatcacagccgctgtttcaggatataacgatcagctttgaaaaagggaagttttatacaattgccggcgcctccggaacgggaaaaaccacgtttctgtctctggcgggcggccttgacacacctaaagagggaagcatcctttataacggagaagacatcttcaaaatcggattaaccaaattcagaaatcaatatgtctctatcgtctttcaatctcatcatctgatcccgtatatgacggcgctccagaacgtcacaaccgcgatggagattaccggatctaaggagaacaacaaagatgcgtccgcgctcagcatgctggataaagtcggcatcaccgaacagcaggcccgtcagcgggtgctgacattaagcggcggacagcagcagcgcgtttcaattgcgcgggctttctgctgtgacacggatctgatttgcgcggatgagccgacgggaaacctcgacgaggatacgtcaaaggaaatcgtccggctctttcaggatctggcgcataaagacggcaaatgcgtcatcatggttacgcacgacgaacaaattgccaaagtgtctgatatcaacatccgcttatcaagaggaagtttcacggtcaaagaaaacggcacggccgtttcctgataccgcgcccctgccagcgcagacaggggcgcaccctatatccccctattcaatagaagtgaacgtaaaaagagccagggctgcatcccctcgctctttttatttatatcagctgtaaataacggtcaatatttgattgtccggctgctttgatcaattcttccgcctttttctcttctcccggcaaagcgagccggagcttgtcttcaatgtctttttcagaaagaccgtttcccggcgctcccctcggacagtcgatacgtgcttcatagacatgaccgccggaaaccgtgacccgtacaattgtaaaacggcccttcggaacggcgttgtcagccggctgaatttggtcatcgcagctgcggtgaatccgctcaaatcctttttgaagggattgcggaatcggctcggatgtgaaatgttcaactgaaaaatccttaccgtgcaaagctaaggtgatcacatattctacgctgaaccgacccgcttcgcctgttttcggacgccgttctgtcaatgcggcgtccccgcccggcggataaatcacgtcaatccgttccgtttggccgaaagtgagaccatgttcggccttcagcttgagaatggcgtccgccgcatgatgggccgccgagcaaaacggataaaccttaaaccaaagtcccggactcacgatccgccaagggtttccccacccgtttacaagcagggtttctgcccgttcaagatcgccgtacagtccgaaaaaacctttctccccgtcgagcgcatgagctgagccgccgaaaccggcctttgcaagctttacggcgaacaccccggcttgagcggccaggccggcgtggagcggcttcatttctgtcccgaattgcactctcatgcctccggaacgggcagccgcaaacccgattgctttctgtaattgggtttgattcagattctctgcgaatccgacggcgcatgcggccgaaatggcacctaacgttcctgtattgtgccagcctttctcgtaatgatcccttccagctgactcgccgagccgcgccatcacttcgattcccgtcacataagcaccgagaaaacggctcttgtctatccggccggctgatgcggctgcaatcaaagccgggaggatgaccgcgctcggatgtcctcttacatcagaatgaacatcgtcaaaatcaagcgcatgtgcgatgaagccgttaatgagcgcggattgggacggcgtggttttttgatttctgccgataagcggcgctatcggcatcccgccttcttcttcggccagttttaccagcttttcaactcctgtatcccgtctccccgcaaaagcagccgctgtaaaatcaagcagtcctttgcgcgcttctttcatcgcttcggcggatgtttccggcacagacgacatgacggcctgagcaagtccggccgtcagattttccgtattcattccgtctgctccaatacattgacggcaagccgggcgaaaaactcagccgctttcggaagcgctttttcgtcgagtgtaaaggctggatggtgccattcttctgttccgtttgttcccatccagacgaagaagccggggattttttcttgatataatgcgaagtcttcgccgccgggcgactgttctgcccgaacggtttgaagtccgaggctttcagccgtttgttccgccgcctgtatgaatcgggcatcgttcatcactgacggcaggtaaggaaaccagcggaagtcagcctctgccccgaatccggccgcgattccttcggcaacccgcttcatatgtttcggaacagcgtcccgcgcttctttttgaaacgtccggacggttccttccatttcaacatggtccggaatgacattccaagaactgcccccctgaactcttgtgatgctgacgacggcattgtgaagcgagctgatgtttctgctgacaatcgattgcaggccgccgatgatctgccctgtcgcctgaatcgggtcaatgctgttgtcggggattccggcgtggccgccttttcctttcacggtgatttcaaagcggtcgacactcgccataagcgggccttctttcagaccgaccgtgccgacggggaggtcaggtttgttatgcatgccgaatatcgccgatacaccgtcaagcgcgccggcttcaatgacctgtcttgctccggcggcgatttcttccgcgggctgaaaaataaaccgcaccgttcctttcagctcatgctttctctcatttaataagaaagccgtgccgaggatagatgccgtatggaaatcatggccgcatgcgtgcatcacgccgctgttgcgcgaagcaaacggaaggtttgttttctcttcgatcggcagtgcgtcgatgtccgctctgacggcgatgacggggccgcttttatctcctttgatttcagcgatcactccggtttgaagtttcggcacatcaagaaccgtgattccttcttcctccagccagcggcggattttattcgtcgtttcgaattcctcgcctgacagctcagggtgttcatgaaggtcgcggcggatattgattaaacgtttgtttaatgattcatacgtttcatttgccatttcttcttcttcccttcttagacaagttcggcaggctctcccacttgcttaatgaattttttcgtccgttcgttctgcggattgtcaaacagctcctccggtgttccctgttcgatgatgcgtccgtccgccataaaaataactttgtcggctacttcacgcgcaaaagccatctcatgcgtgacgatgatcatggttgtctgtttttcggcaattgatttgatgacttggagcacccctgctacaagctcagggtcaagggctgaagtcggttcatccagtaaaatcgcgtgaggatcaacggccaaggctctcgcaatcccgatccgctgctgctgcccgcctgacatcgtaatcgggtagctgtccgctttgtgttctaaaccgacttgccgcagcaggtccataccgatctgttccgcttcttttttcggtttcttttgcgcggtgatcagcgcctctgtcacattttgcagggcggttttgtttttgaacaggttgtaattctgaaacaccatcgccgtctgctggcgaagcttgtgtacgtctttgcgcgaataggacgctgcattcagctttgcatcgccgatttcaatgatgccgtcatccgggcgctccagcagattcagacagcggaggagcgttgattttcccgagcctgacgggccgatgatggccgtgacttcgccgcttttgatctcaagatcgatcccgtcaagtacggtaagatctttaaatgcttttcgaatatgtctgacttgtatcatcctgagcctcctcctatgtgcgataaggcttgctgatcgcccgttcgagcagatcctgcagcacactgtaaataatcgtaagaatccagtacatgaccgcgacggctaaatacgtctcaaaatatttgaggttgcccgatgcgtacatttttccttgggcgaacatctccatcacacctaatgtaaaagcgagcgatgtttcttttaacaggccgataaacgtatttcccgtcgcgggaagcgcgtttctgacggcttgcgggaaaatgatccgtctgtacgcctgggattttgtcattccgacagacagacaggcttcaagctgcccctcatcgactgagttgagcgcagcgcggaagatttcagccaggtaggcggcatttttcaggcttaacccgataatcgccgcagttaacgccgtcatcttgctcatcccgggaaagagctgaggcaggccgtaataaattaagaaaagctgcacgagcgtcggcacgccccggaaaaatgaaatatacacctttgacagctggtgaagcacaggaatacgattttttgtgataagcgctaatataaggccgccgatcacggcaaataccatggccgcgacggccattagtaatgtgatcggcaaggcttcgattaacgcgggaaaagctgaaaacataaatccccaatcaatgctgttcattctcgattttcaccgccgtttcttattgctttgcttcctttgtgatatcttcgttaaagtacttttcagacagctttttcagcgtgccgtctttccgcaggtcttcaatggctttgtttacttttttgcggattttatcgtgagccgcatctttcgcaaacgggaaagcgactttttcatagacaatcgggtctcctgctaatttcagaggcagaccggtctttttgatctgggcgatcaggacgctgcggctgtttacataggcgtcaacccgtccgtaagccacgtctttcagcgtaccttcttgtgtttcatatgtttttatgttgatttttttatccgggtccttgctctcaaggtttttcgcgtggtttgagcccagaacggccgccactgtttttcctttcagatcattgactgatttgatgtctttgttatcgtttttgacgacgacttgagtgcccgcatacgaatacggttctgtgaagttatacgttttcttgcgttcgtccgtgacagcgacctggtttgaaatggtgtcgagtttgccggtctggagctcgcccatcagtccgctgaactcaagcagcttccagtccagtttcatgttgatttttttcgctacggcttccattacatccacgtcaaagcctgtcagcttgccgttttctttatatgcgaacggatagctttgtcccgtagcgccgacatgcagcacgttatcgccgccttcgctttcttttccgtttccgcatgctgttaagaccgccaaaagcgcggcagacagcagcaaagcccatgttttcttcttcattgaaatcccgccttttcctattaaaatgttaatcctgcaattgtttttttaaatagatggtgatgtggccttttcctaaatccttttcgcctgcgcggacgtagcctttccgctcgtacatgccgatcagccacggatgcttgtccgctgtgcccagtgacacgaaaggcgcttttaatgtatcgcggagcactgtgttctccagccactccagcatgtctgagcccgtccctttttttccggtttcaggatcgacggcgaaccaccaaatatgagggacaccgtacggcccgggattcggcccccacggcatccgcagagaaatcgtcgccagaatccgtccgtcttcctccaaaacgtaacaggcgtttttttgtatgttattcaaaacgagctccttatccgccgttgctgcggcaaagttgatgccgagcttgcggatcggttcatacgcccgcagtgtcagtgaaagcagctcatcagcgtctgcctccgttgcgagccggtattgtcttgacatgatgagccctcctttagtcggcatatcggtttgccggtttttccagtccgaaatgttctctgagtgtggttccttcatactcttttctgaacacgccccgttcttgcaaaatcggaatcactttgtctacaaaaagagtgagaccttcaggcaaaagcggcggcatgatgttgaagccgtcacaagcttgttttccgacccattcttccatcttatcggcaagctgttcaggcgttccgacaaagatatgatggcctcttgaacccgccacatatttgtacagctcgcggatggtcatgttatcgcgtttggccatctcctgaacgagcttgaaccggcttttaacggcattcgacgcatccgcatccaattcaggcagcgggccgtcaagcgggcaggcggaaaggtcgacgccgcccagatagttttgcagaatgttcaggccgacagacggaatgatgagatcttggagctcttcatattttgcctgcgcttcttcctcggtatcggcgataacgggaaatatccccggcatgatcgcgattttttcaggatcacggccgaaagaagccgcttgttctttaatagattgatagaattcctgcgcggactccaaatgattttgcgcggtgaaaatgacctccgccgttttggcggccagcgcttttccgtctcctgatgatccggcctgaataatgaccgggcgcccttgaggtgtgcgggcgacatttaacggccctctcacggagaaatatgttcctttatggttcaattcatgcattttttctttatcgaaaaatgctcctgactctttgtcacggataaaggcgtcttcctcccacgaatcccataatcctttgacgacttcaacgaattcttccgcgcgctgatatctgagatggtgctcaagatgcttttcgccgctgaaattaagcgcggtcgattcaatcgaagatgtgacgacattccagcccgctcggccgttggaaagatgatcaagcgatgcaaattgtctcgcgatatggaacggttcgctgtatgtggtagacgcggtcgccgtcagaccgatgcgggatgtgacctgagcgagcgccgacagcagcgtaaacggctcaaagcgcgtcagcacattcggatgtgatttgccgtctattgataaactgtccgccaaaaacagcatgtccaatttcccccgctcagccgttttcgccagttctttgaaataatccaaattcatgctcgcgtccgccggtgcctgaggatgtctccaagaagcgacatgatggccggtgcccgcgagaaacacaccgagtttgatttcttttttctttgtcatgatggatctccttctattctgaaatacggttcggaaaatattaacaccactaaacctatatttcctagtaattttataagaataaatcaaaatgtacaattgtcacgcaagtttgtcaatgcattaagacaaaaatcatgattttaaaaataacccggcgcaccgtccgggttatttcttcgaaactgtatagacggtccctttgacctttttcttaataacggcaatgataagcagcaaaacgggaaacagcacttgaaacggaagatgaatatagatcggcacaatgtttaagccttcattcatgtgttccgaaaaattgcttgcgatgctgatggagagaatcagcacccccaatccgaccggaaaggccagctgagacggatttttttctttaaacagcgtggacacacccacgacaaccgcatatgtaaaaaggctgactttgaaaaaaccgccgatgacgagcacgagcatgaaaaagacatccagccggtctaaaaactcttctactttaatcgtctgtatggtgctcagcagcggaaattgagagcggagcattaagttgacgtccagcacacaaatattaatcgccactgacatcgccaaaaacagcccgctgatgataatcgccagaaatccggttttcttcacctttttccgatcttttaaataagggaaaatcatgacaaacacgattaattcaccgaacgggatgaacatcgtctgtttaaacacggaataaatgaccgttcctgcaccctccgctaaaacgggctggagaaatctgaggtttatcgtgcctgagctgataatgaggatcagcccgacggctgtcagaaaatacataatgccaaacagcagctcgccggctctcgctatcacttcaataccctttctgaccgcaaatatcgcggcgatcatcagcatggcattcacaattaaaagcggcgtgtcctggtaggcgaaggtgacaagcatttcgccaaaatcccgcaatacgcgggccgcgatataagaaaaatagagaatataaagaagcgagaccgcccagctcagatgtctgccgatcagttcgttcatgtaatctctcggagaagactcaggaaaaaattgatacagcgcctgataaacgtagaaaagtccgagaccgataacgcacccgagaagcacggacagccatgcatcccgcccggccatcgtgcctggcgggatcaataacgaactgcccaattcaaacaaaatgatcataataaacagctgacgcgtgccgattttcgcattttccatacgcttcgctcctttctcctcaaatcaatcatgctcaagcttgtctgagagaggattattccgcaagcccgttcttctgataatgacttccgttttgacatctacggggagattggggaaatattcttcatcccacttccctttgaactttttccatttgtccggatgcttccgatagatcaggtctccgaagccgacgaagtcattcttacgggcttttatatcttcaattgatttggtgatatctttgtcaagctgcacgctgagcgccttttgcatcgtcatcagcacttgcggatcagacagatggaaagggtatctgacagcgtccaccagcccctcgacctgagcatgcacgtgaatatgcggttttccgttcggaaaagtggccgtcacctttgtattctggcgggtgacctgcagactgattgcgtgcttcacattcttccaatccgcattgatgaacgtatgcttgatcctattgagcagccatacagcccccacactgtcgtcatcctcaatccagtaatccagcctcccatcctttttgaacaccgccagtccgtccgctgacagcactgctttcggttcagtcgtctgcgtattttccatcgtaggaccggctttatcgtctccgtgcatttcataacccggaataaacggcgacccggccggagaagcgagatcaatcagaacgtcctgaaggctggttttaatgactctgccgtattgttcctgcgtgaagctgagcgtcttgttcactttattggaagggattttatcaatcggcgtcagcactttaataatgtcttcagccttgcaattatgcgcgatcaccgcggttgcggtcgtcctgaattcggtgtcgcggtcaagattgtccagaataaaactgagcccttcctctttcgccagcttttcactgaacaccacgagattcgtatgcgcaaaatagagccttctggacactttcatcgagccttttctcaaagcttccgtcatattgtctccggacaccgaatagacggaaaccggaggccggtctcccgctccgccgccctgcagaccgccggccacgtttcccggattgataatttgcaagtgaaggacgtattttcccgtttcggtccggtcaataccgatggcggagatcacagccaaatcagtcagctcccttttatcccagcatccggatacaaacataagggaaaccatcgtacaaaggataagtatccatttacgtcttttcattaccgtcgccctcttctacatctttattaaccatccctctggatgtctccggtttcggtctttgatgttccccttggcgcctgttgttttcctgcacgagcagttccggccttttttcatctgcccataacggagcgcggaggatggaatccttcagcccgcccggggtcaaaggagcgagcggggacatatacggaaaaccgaatgaacgcaggccgcacagatggacgaacatcatgataatgcccagaatcagcccgtaaaatcccatgaccgccgctgacagaataaagagaaaccggatcagccgcgcggatatcgccatgtcaaaagccggggtcgcaaagctggcaatcgccgtcagcgcgacgacgataaccatggccggggagacgatgccggcctgtacggcggcctggccgatgacaagcgctccgactatggaaacggcggagccgacaactctcggaagccggacacccgcctccctgagaatctcaaaagccacttccatcgtcagcgcttcaatcacggccgggaacggcaccgtctcccgctgagccgcgatgacaatcagcagctgcgtcggaatcatttcctggtgaaaggtcgtcgccgccacataaatccccggcgccaccagtgaaatgaagaaaatcaaaacccgcagcaccctgatgcttgtggcgatatcaaatcgtgaataataatcctcaacggattgaaaaaattgaataaataaggccggcgcgatgagaacgaacggcgttccgtccacgataatcgcaaatcgtccttccagcagattccccgccacgacgtccggccgctccgtatgatatacggtggggaacacagaaaacggcgcgtcttcaatgagctgttcaatgtagccggattccaggatgctgtcgatgtcaatgtgcttcagccgcttgcggacttccttaatcagctttttatcgcaaattccgttaatatacatcagcgcgacatccgtattcgtttcgtgtccgatctccattttttcaacccatacatcaggcgtttttacatacctgcggatcatggaaatattggtttgcagagattcagtgaatccctggcgcgggccgcggaaagagacctgagtgctcggctcttgaatggaccggtgctctcccccttccgtgctggcgatcagcgccttgtcagccccgtcgacaaaaatgagcgtgctgcccgccaccagcccggcataaaggcttttccatttttcttcctctttcaccccgccgatcgcaagcgttttatcgtatatcaggcagaccgcttgttccggctgaacggacgggatatcgattaaatcctccagaagggattggctgacaagctgttcgtctaccaaaccggcgatatacacgattgcggccggaagctcttcttttccgattttcagccggcggatgacgacatcggcactgttgccgaacctctcagacagcttcttcatattttgctttaagctgagggagatcggctcatcccgctctttgtccggctggctgtccgcttcttttctgccttcattgtcacggtcgttttgatcggcttttttttgtttcctctgcttaaaaaatggcggcatatcgcaaaaaacctttcctcgtttttttcatattcttcctgtacggcaaaagattatgcacggcggaaagtctgtataagttctgcgtaatcgaaaaggataaaaagggagagtgatgcgcatgaaaatattaggggtttcattctttttgctgactgcctgtctgatcatttcagtaacggtggatatgctgcaaggtttcagtttctatggagcggttcaaaacaacctgtccgcttttaaattgaccaccttctcagaatggctgatgctgtttttattcgccctctttttaatcagagaaatgatcgctttatataaatcaggtaaaaaagatgcctgacaggcgcaaggctgtattgtgtcaaaaaagaacacattcctccttctctcggagttcatgtgttctttttatttttccggcgcagattgttctcagatgacgatatttccgctttccgtatctgtcgcgtgcttcacaatgacgcctttgataatgcggttgccgatgattttagtacttgcggaggagctggtttggatggcggaagcagaagcggcggataggttgttgatggtattgcccgaaacgagggaattggaggctccgttcagatagatgccgatcgggctgcccgctgttcggttgatcgtgagcgtattgtctatgacttcatgcgtgcctgagttcagatacacggtaacgataagcggtgatgattcaaagcggttgctgatgacagaggttcccgaggatgttgaactgaatacgggatagtttttatagttcttaaagagattgcctttgatgacagccccggcgtcatttgtcacagatacggcataggactccgcggcgccctgatacgcattcggaaggagcgtatttccttcaataacggcatttccgcctgtgacccatatgccccggctgaacgatttcagcacattttgttttacaatgatactgccggccgacatgctgattccgtctgtcacctgattcagagtgttattcgtaaagacggcgttctccgaaagcgtcgcccgcatccccgtgcttcgtctcgtttcggaacgtccgttttcaatgacattgccgtcaacggtcacatcttctgcctgatagacggaaatgcccgtattttcaaattgattaattttgttgtgggtgacgaggacgctttttccccttacatctattccggtggaaaacccggtaatcagattgttggaaatgacggcactgctgctgtcctgtccttgtgacacaccttgtccggcgactgcggtccttgagccgccgtctgaccgaaagaagacattccccgtaatgacggtatgcgccccatacccgtagctgattgtgttatcggaatgatttccttcaattaacacattatatccgttaaaattggtgactgagcttgcggcgtttccggaaaagaagttgttgcggaccgtaatatgaagagcttcttcataatcaatatcgccttctccgtacgattcaatatcgattccgaatttcggagccgttccgttcccttgcccggcgtcttcaatcacgcattcttccaccgtaacggtattgcagccggtgattgaaatgttgttccgccttgactgcctgatctcacagcggcggatggtcacctgttctgaagtttcgtaatcactgtttgtttttaacccgagcgggctgacaattataccgtctcccgtaaaatctgaaatcttcacattttcgatcagcacattgctgctgccttcaatacagattccaaacccccattcatgggtcgaccgcaaagggacattggtatacgtgtgttcatcccgttccccgatgatccggccgccggtgatggtgacattttcacgcctgcctatatagaaagccgagtagccccaggagctgttcggcgccactttaatcgtgcattccggatctaaaacgatggtgagatggctcggcacgttaatcccggcgttccgaaacggctggcttttgtccccgccaagcgtgccgttgattttatacgttccgggcggaaaaaacaccgtatgacagccttcgctgacggctctggccaagcattggttgatggcgcccgtcacatcggtttttccgtctgccgccacaccgcaatccgtaatatccaatatacgattcggcaagtgataatctcctccttcctctcttattgtcatcttattccgccatatcccgctccgcctgtacatactttaaattttattaaaaaagtttataaagatagtttagtcagataatataacaaaataagtcattggaatcaggaaaattcgtctatattcaccgttttaatatcttttcattctggaattttttgaattcagtataaattatattgacacaagtattatataagaatatgatttttgtaatacacttttttaagaaagggttggctcaggtggcatctattgataaggaatctataacagaaactgtgccgcaacgaggctttttcggtcatccccgcggcttgttcacactgttttttaccgaattttgggagcgtttctcctactatggtatgagagccatattgctttactatttatacacggaagtcgctcatggcggtctcggctttgataaaacgaccgcagttgccatcatgtccatatacggatctctcgtatatatgtcgagcgtcatcggcggatggctggccgaccgggtattcggcacggcaaacaccgtattttacggcggaattttaattatgttcgggcacatcgctcttgccttccccggcagcacggcggcgttttttaccagcatggctctgatcattatcggaaccggcctgcttaaaccaaacgtatccagcgttgtcggagatttatatacgaaggaagacgagcgccgcgactcaggtttcagcatcttttacatggggatcaacctcggcggattgcttgcgccgctaattgtcggaacactcggacagaagtacaactaccacttaggcttcggatgcgccgcggccggtatgttcctcggactgattgttttcgctctaacgagaaagaaatacctcggcaaagcaggctccaatgtaccgaatccgatttctaaatcatcagtgatcggcacgggaatcggagtggtcatcgcagcagccgttattattgttctgattcaaaccggctggctgacgatccagcgtgtgattgacaccgtcagtatcctcggcattgtcattccggttatttactttatcgtgatgttcacaagcaaaaaagcgacgaaaacggaaaaatcacggcttgcggcttatgttccgctgtttattgcagcggcaatgttctgggcgattcaggagcagggcgcgacgattctagctttatatgcggatcagcgcacgagactttcctttgcgggcatgcatcttgagtcttcatggttccagtctctgaacccattattcatcgttattttcgcgccggtgttcgcgtggatctggatgaagctcggcaaacgccagccttcaacaccgattaaattcgcgatcggcattatccttgccggattatcatttttagtcatggtgcttccggttatgggcggaagcggcgagcttgtgagcccgctttggcttgtgctcagcttccttttggttgtgcttggtgagctttgcctttcaccggtcggtttatccgtcacaacgaaacttgcgcctgcagctttctcagcgcagacgatgagtatgtggtttttaacaaacgcctgcggtcaagccctgaacgcaaaagtagtcggtttgtttgataagatttctgaagcggcctacttcggctcaatcggtcttgtttcgatcattctcggtattattttaattcttctgtctcccgtcattaaacgggcgatgaaaggcgtacaataaaagagaagcctgcggaatcgtccgcaggctttttttgtgcgtctatcgttttaactcctcaagtgtttctctccatctcttcaggacatcttccggttcgtggagctggatggccggtcctgatgtcagatccgcgtatttcgcccgatcttccttgacggtgatcacgcggcagctgaaccgttcccgctcgtgtttcgcctctttcaacggcggaagcgccttacattccaatgtgacgtaatatgcggctcctccgtgccaggcgatgaaaagagcttgtcccgaatgcagcaggctttttacggtcgtcgtgtttttccataaggcgagccggagatttgttctgctcacggccgcgatttcaccggcgctgatcatggccgcgtgcggacggccttcttttgtcacggattggagcacaaatgcgtcgtgctgctttttttcaagttccgttccgtctaaaagcgcgtaaagcgcctccggcaagtgctccgtcagcattacgcttttctttccgggacagcgggaacatgtgtggccgtctctgtttctttcggatcgattttaaatgccgggttgaatgccgccggattcgtgatactttccggttcacaggatctccatgtgaaaaagcaggtttggcattggtatatttcccaagcgcctttgaccggcgattggctgacggtttctcctttttgcgattcacatcgcgggcatgttttcatagtaaactcatcctttcttattgattcattaagtccatcagtttttgttcccactctttcgttgtcagcggggaatcaagcggctgcgaataatggcctcttgtttccggcgcgacaggcgtcgtggcgtcaagaatcattttgtgtgtcatccctgccggatcagaccccgggtcaagcggaaggacggacagatcaggaatgatgactgcatcgtgtttcggatgcattttcgttgagagcgcccacatgacttgcggcaggttaaacggatcgacatcctcatccacgacaatgaccattttgcagtagccgagtccgtgcggcgtcgtcagggcgcgcatgccgacggccttggcaaatccgccgtagcgcgttttcgtggagataatggcgatcagcccgtgcgtatacatcgcattcacggcgacgatttcgttcggataggcttccttcagctgctggtaaagcggcacgcacgtattaatgccgatcatataatcgcactccgtccacggcatgcctaagtataaatgttcaaaaatcggattgtttctatgatatacccgtttgattttgatcaccggcatgctgcggccgcctgaataatggcccgtgaactcaccgaaaggtccttcgtattcccgttctcccgcaaggatctctccttccagaacgacttcagcaccccaagggatgtctaaatcagacaatttagatttaacgattctgtagggctccccttgaatcgcgccggccatttcatactcggattgatcgtataacagcggagttgatgcagccgtcgtaatcaccggctcacagccgagcgcgatcgtaacgggaagattcacgccgcgttcttcagcttggcgaagatgaatcgcaatatcatgctgaggcacgggctgaatgccgaggcggtctttcccctttacctgcattctgtaaatgccgacattctgcttgccgaaattgtccggatcttcaagatcgcgggaaatgacgcacgctttatccaaatagtagccgccgtccccctggttgattctgaatagcggaaggatgtcaaatagattgatatcttccgttatttcattttcatgaaacggcgcggtttcttcccgtttgaccggcaccggaaatgcatcgtaccgtttggcaaactcaaagaattgttctttaacaggcgtatctttcggcatgccgagcatcatcgcgtgattcggccacgagccgatgacattcagagccacctgcgcatcgtgatgtccgtaaatattgttaaacaaaagcgcaggggttttatccccgagattgctggctgcacgcgcggcggcgcccaggtccggctccggttttacctcttcgttgacggttaagagctgcccttctttttcaagagcggcgagaaattccctaaaatcctgataggccattatcagattcctcctttttgtttttcaattccgtaccaccgtttcgcttccggcagacggatgccgaactgatcgagcgtccggaacacaatatggtctatcaattcatccatgtcagccggcttgttatagaatgccggcatcggcggaagaatgacggaacccatttttgtaagcgctagcatattttctaaatggatttggctgagcggcgtttctcttgtcagcagcacaagttttttccgctccttcaggatgacgtcagccgcccttgtcagcagattgtcagccattccggtgcggatgcttgccagtgatttcatgctgcacggagcgatgatcatcccgtccgtttcaaacgaaccgcttgaaatcgccgctgcctggtctttgtgagaatacgtataggatgcgagtttctcgacatcttttaacgtataatcggtttcatgtgtaatggtgacatttgcccaaggagacacgacaagatgggtttcgatctccgcggcttttaaatattctaaaagcctgatcccgaatatggctcccgttgccccggtcattccgatgacgagcttcatattgacccctcctttacgcttgaaatgtggtgtcaaatccatcatactcctgatatatccatatgaaaaatattcgttaaatctatgtatcataccttaaaggtataaaagaaaggagcgagcgttctcatggatattcggcaattgcgttatttcatcaccattgcccaagagcagaaaatcacgacggccgccaaaaagctccatatggcacagccgcctttgagccgacagttgaaacagctcgaagaagaattgggcgtcattctgtttgaccgcaataaaaagaaacaaatgaccctcacatatgaaggaaacgtctttttgaaaagagcgaaagagattcttcataagtttgaggacgctataatcgaggtacaagagctgaaggaggaggtggccgggacacttgccgtcgggtcaaccatttactgcgcagcgctcatgcttgagaaagtgtcacagatgaaagagcggtttccgcatctcacctttaacatttgggaagatgaacccgtctcactgctggagcttctggaaacccggcagattgacgccgccgtcaccaccaccttgattaaaaacgacggcattgaatcgaaggagcttgaagacattccgtgtgtattggtgctgtccgagcattcaaaacgactgtgcggagaaacgattaaactgaatgacatcgcctctttgcctctgatccttttgcgcaccgtcaatggaagaggtgtgtatgaccaagtcctccaagtttgtgaacagtacggtctcgacctccaggttgtttgtgaatgccatgactccgcgacgctcttgagccttgtatcatcaggattcggcgccacaattctgcctttgacgatgattcccgtccatatgcgctcgcatgtcaaaacggttatcatcgaagacaacccgtttgtcatgacaccggccgtcatctggagaaaagacagctacctgccgaagcctgtcagacagtttttggaattattttgatccggaacacgatgaattcccgcttatgaaaaccaattacttgactcatactaaaaaaaagttatcctttacaattgggagctattttttctcaataaaactactcagaaaagtggggaataaagaagatgaaaaaagcattattcgctttgttcatgatggtcagcatcgcaatgcttgcagcctgcggaaactcacaggacagcggatctaagtcaaaagacggcgatctttgggcttctgtcaagaaaaaaggcgtactgaccgtcggtacagaaggaacgtacgaaccgtttaccttccatgataaaaagactgacaaactgaccggatatgatgttgaagtgattcaagaagtcgcgaaacgcctcggtctgaaagctgactttaaagaaacacaatgggacagcatgtttgccggtttaaacgcgaaacggtttgacgtcgtcgccaaccaagtcggcaaaacaggccgtgagaaccaatatgatttttctgataaatacacaacgtcaaatgcagtcgtcgtgacgaaaaaagacagcacgattgcgaaagaggctgatgtcaaaggaaaaacagcggctcagtcattaacaagcaattacaataaattagcgaaagaagccggcgcgaaaattgaaggcgttgaaggcatggcgcaatcccttcagctcattcagcagggccgcgctgatctgacttacaacgataagcttgccgtactgaactacttaaaaacgtccggcaataaaaacgtgaaaatcgcgtttgaagcaggccagccgcagcagacatatttcgcattccgaaaaggaagcggcgaacttgtgactcacgtcaacaaagcgttaaaagaaatgaaagaggacgggactctttctaaaatagcgaaaaaatggttcggcgaagatgtttctaagtaacatgccggaacccgtgattgcaacagccattccgtgggatttggtgcagcagtcattctggccgattctttccgggggaatctattactcgattccccttaccattctttcctttattttcggaatgatcatcgcgctgattacggcgctcgccagaatgtcaaatatgaaaccattgagatgggtgttcagcgtatacgtatcagcggtgcgcggcactcctcttctcgttcaattgttcatcattttttatctgttcccgacatttaatattacgctggaccctttcccaagcgcagtcatcgcgttttcattaaacgtgggcgcctatgcttctgaaatcatccgggcatctatttcatccgtgccgaaagggcaatgggaagccggttatacgatcggcatgacctatcgcaagacattgttccgcgtgatcctgccgcaggcgtttcgcgtgtccattccgccattatcaaatacatttatcagcctgatcaaggatacatctctcgcgtcacagattctcgtcgcggagctgttcagaaaagcgcaggaaatcggcgcgcaaaaccttgatcaaatcttggtcatctatattgaagccgcctttatttattggatcatctgcttcttgctgtcaatcgtacagcatgtgatcgaacggcgtctcgaccgttatgtggccaaataaggaggtttcgatatgctttccgtcaaaggattaaataaatcattcggacagaatgaaattttaaaaaagatagatatggagatagaaaaagggaaagtcatcgccattctgggaccgtccggttcaggaaaaacgacgcttctgcgctgtctgaacgcgcttgagatccccaatcgcggcgagctggcattctccgatttttcaatagatttctccaaaaaagtgaagcaggctgatattctccgcctccgccgcaaatcaggcatggtctttcaggcgtatcatctgtttcctcaccgcacggcgcttgaaaacgtcatggaaggacccgttcaagtgcaaaagcgcgacaaggagcaagtcagaaaagaagcgatagagcttctggaaaaagtcggactgaaagacaaaatggatttatatccgttccagctttccggcggtcagcagcagcgggtcggcatcgcccgcgcgcttgcgattcagcccgagctgatgctgtttgacgaaccgacgtcagcacttgatccggagctggtcggcgaggtgctcaaagtgattaaggatctggcgaacgaaggctggacgatggtcgtcgtcacccatgaaatcaaattcgcgcaggaagtggccgatgaagtcatcttcattgacggcggcgtcattgtggaacaaggaccgccggcccagattttttccgcgccgaaagaagaacgcacgcagcggtttttaaatcgtatactgaatcctttgtaggagccggagaagaagcgaaacactgatttcgcttcttctttttttgggcggttatgctacaatgacaattaatgaatgttatgaaagaagggacctctttgaagcgggaattcttgatgcgctggacgttttattttgccggtctgttgattttgtctttcggggtatcgttaaccattaaaggaaaagctctcggcatcagcccttgggatgcctttcattatgggctttttcagcatttcgggctatctgtcggccaatggtccatcttggtcggcgcggtcatcgtggctttaacctgcctgttcacgaggacgctcccgaaaatcggcgctatcttaaacatggtgctgatgggaatgtttattgatttcttctcgtttctgcttcctgaggcgcacgctttttccttagcggccgtgtttttttctatcggattgctgctgatcggctgcggcgtcggtatttacgtatcagcagggctcggcgcgggcccccgggactctctgatgatgctgatatctgaaaaaacgggctggaacgtgcaatgggtgcggaacggcattgagctgacgattcttgccgcagcctgggtgatgggcggaccgatcggcgccggaaccattattacggctgttttgacggggctgattctgcgtttttctttgccgcagtcctctaaactgttaacatacgcgatctccgggcgggcaacgtccgttcattaaaaacaaagccgaaacggttttgtttttttattttcggacagctttcgtctgatatggtaggatggttttgacaatattttcagacggaggatctggacatgaagatttacggagtatatatggaccgcccgctttctgcaggggaagaggatcggatgatggcggccgtgtccgccgaaaagcgggaaaaatgccggcgcttttaccataaggaggatgctcaccgcaccttgatcggcgacatgctgatccgcaccgctgcggcgaaggcttacggacttgatccggccgcgatttcattcagcgtccaggaatacggaaagccgtacatccccgcgcttccggacatgcactttaacatttcccactccgggcgctggatcgtgtgtgccgttgattcaaaaccgatcggcattgatattgaaaaaatgaagcccggcacgattgatatcgccaaacgttttttttcgccgacggaatacagtgatctgcaagcgaaacaccccgatcagcagaccgattatttttacctcctgtggtcgatgaaagaaagctttatcaagcaggccggaaaagggctttcccttccgcttgattcattcagcgtccgcctcaaagacgacggccatgtgtccattgagctcccggacggacatgaaccttgtttcatccgcacatatgatgcggacgaggaatataagctggccgtttgtgcggcgcatcccgatttttgtgacgggattgagatgaaaacgtatgaagagctgatgtaagcatagaaaaaggagggtatccccctcctttttttgtcagcctgatatttccgcctgtttctgcagctgctttgcttcttgataaatttcttcgaacagatccgcgatgtattcttcttcaacacatgaaaatgcgattcgcaaatcggtttcattaatggatatcgtcccgattcctctcttttcaagcaacgacactcttaattcgccggcgtttatgtctttcagccggacacacatgaaataacccgagttaaacggataaggcgtccatacgtcttcatagtgcttgttttctgcaagaacggctttcactttgtcagcccgttttttcatgatattatatttcagcgatttttctttctcgtattccggtgactgcatcgcccgcagcataaacgtttgggacggatgcggggcgcttgaaatcgttcccctgataatcccttttgttttttcctcgagcacgcgcagcgctttttcgctttttgtgctgtacgtaataaaaccgacgcggaagccccacgcgtaattttccttcgtcgcgccgtctatttttacgcaaagcacccggtcgtgcacttgggcgagtttgctgaagatggattcctgaatggccgtttcatcgtaaaacagattgtaatacgcatcgtctacgagcacgacaatctctttgccggcctccgctgcctccaggatcacactgacgatttctgacgcttcctcttcccccggcgtatagcctgtcggattattcgggaaattcagcacgacaatcgccttttcttcctgctttttcagcagctcggacagccccgccgcattaaaacgcccatcctgctgaaaaagcgggtacgtctcaatggatgccttgcgccggacaccgaaaatgaaattgtaatttccccaatatttatccggcagaagcagcgcatccccttcattgacgaacaagtcggcggcaatgctcagcccgtgtgttaaagcgtttgtcacgatcggcgtgctgatgtctttgccggctaatgaaggattttcgagacgcatttttttcagccattcctgtctgagcggctcttttccctgcggcggagcataatcgtagatatcatcggggttataggcggacagtgtctcttgaatatgggaaaagtgcatggactcgccttgtgaggtggcaatcccgatcgtggcattatactttccggccttggctttcgcttccgccgattgtgtcagcacccctttcggataaaacaactctctgcccaaatcagaaagcatatgaagcacgtgcgggttttcttcagataatgttctgttcagctcttttgctgcatcattcatgtacgacaatcccttcaaaattatattccatcaaatcataacataaaatttttgataaatgagaaaactcacgggcagattttgttacaaaaaacagacagcgaatgctgtctgtcatatcctataacaattggcctgcagtgctcctgttaataatctcatatattcgttccgccactttttcagtttcacttaatatgaacatgtggccgtccgaaaactcatgaaatacgggattgtcggcccattttttccatccgtccgcatctttgatacattttttatctttccgcccgttaaaaatatggacgggtgattgaatcatgtgagaatcagacggacggaagctttcaagcgcgcggtagtcggacctgaaagaaggcaggaaaaatgacatgacctccttattctccactaactcctgcggcattccgcccagctcgataatatgggcgagaaatttttcatcatcaagatgagacacttttttcctttcaacatgcggcggctgaatggctgagatgatcacggcctgcgggtaaatcccctcccgctcaagcttttgcgccagcctgaaagcgaccatgcctcccatactgtggccgaacaggacaaacgggcggtcaggatggagattcaactcctgcttgtataaactgacaagctgttcaaaatcctcaacggcggacatttgatttgttccgtgtcccggcggttccgcggcaagcatctcacactcaccttgaagataggtgtggagcgggcggaatgatgcggaatagcctcctgcgaacggaaaacagataagctgcgttttttccgtggtatcgaacgatttaaagagctggaccattggcgggcttcctccttttctatcgtgaagctgtcagcttcggatgttccttccttaggaattcgagcaaatatgccgcattcctttcgagacattctccctgaagcatttctgcgtgactgccgcagccttttttcacacggtattcacctgtcgtggcttcctcccacgaagcgagccacggcggcatcgcaaagtccggttctgacgttaatagatctatatccgcattgaccgtgccggtgctgacggtatgcacgaaataagaataaaacgcgtttgtttttttggcgagaccttctttgacggcttcgtcattcagcgcttcgttatcccggtttaccttcatcagcgcctggacatcgctttctacggtgcggccttccaagtcgctgacgccttgttttttataggaatcaaccatgatcagccgctccactttacgtccttcggcttcaagccgtttggccgtttcaaaggcgagcgtgcagcctgccgagtatccgaacagcttgaccggtccttccggctggagctgattgatcagctctgtgtagcgttcgatgcggttgtcttcctcgataaaatcaaacgcacagattctatagccggacagctgttttgccagcggctggtacatcagcccgtaaccgagaaccggcgggaacgcaaacagtgtgtcagactgatttttattcatgatggtgagatctttcattcctttttcttcaccgtgaagcagataaccggcaatgtctgcgattgtcgtcgcttcgaataacagctgcaccgggatgtccgtaccgagctcttttttaatgcgcgacgctgccgtcatcgcttttaaggaatggcctccgagcgcgaagaaatcatcatgaatcccgatctgctgtctgccgagaatctcggaccagatgtgtgcaatcgtttcttccgtcgcgtttcgaggcccgatccattctttcgccgcctgagcctgatccggtttcggcagctgccgtttattgaccttcccgtttgtcgttaaaggaagctcttctaagaaagtaaaggtttgcggcaccatgtaagcaggaagctgttttttcaagtgcctctttacgtcttcagctgaaagcggcgtccggttcacgagataggcgttgattgatgcatctccggactcatggcggtctgcaacaacgaccgcatctttcacacccgggtattcctgcagctgcttttcgatttcttcaagttcaatccggtgaccgcgtattttgacctggtcgtcaatacgcccggcgtattcaatcgttccatccggcagccagcgtgctaaatcccctgtgcggtaaagcgtttctcccggcttgaacggatttgggataaacgtttgcttcgtcaggtcgtgacggttcagatacccttttgatacacccattccgctgatgcacagttcaccgacagctccgaacggctgaagctggttttgcccgttaagaatataaatacttgcattgctgatcggctttccgatcggcaatgaggaaatggaatccggtatatcatgcacgacgtgagctgtcgcaaacaccgttccctcagtcggcccgtaacaattaatcagcttgccaggccccatgatctcaagcgcctttctgacgtgaggcacagacgcgcgctcacccccgaataacacacagcggagccccttcagccactcctctcccgcatcggtgagaagattaaaaagtgcggttgtcgcaaacatgacattgacattctcctgccggatcagatcagtgagccgttctgtatcaagcagtgtatgttcatctgcgataatgagccgtgccgcattcaggattgatgcgtagaaatcaaaagtaaatgcgtcaaaggcgtaattcgaaacagataagaacgtatcttgttcagaaaatgccatatagtctacatgcttgaccaatccttgtatattggcatgagtggtgatattgcccttcggctttccggttgtgccggacgtatacataatatacgccggatcatcgggatcaattgcggctgcaggatcgcttgcctgttcctcaaaccgtgcttgatcatcgatgatgagtgttgttcctgtatacggcagctgagccgctttttctttcatctcctgatgtgtcagcagacaggcagccgcactgtcagtcagcatatacgagattcggtcctccggcagcttcggatcaaccggcagataagccgctcccgcttttaatacgccgagaatgccgatcaccagttcaagcgagcgcttcgtgtacaacgcgacaacggtgtctttacccgcaccttgcttttgcaaacggcgcgcaagacggttcgcttcctcatctaattcgcgataggaaagagtctggccggaatacgtaagcgccggtgcatcaggatttacattcaccgcttccttgaaccaatccgtcagaggcttcgcctgatgagtctcagccggcgggtttaagccggtaagcagaagctctctttccttttcatcaacaagtctgatcgtattgacagggtgatccggcttctggatgagctgctgaatcgctgtgagaagctgagattttaagcgcaggataaacgcctcatcaaacacattcccgttataggcaagcttaatcagcatctcatcacctggagaagccatcaggttgagatcataattcgatttctcaaaaacatggacgtcctccatatcaaagccgttttcactgttctcttcattttttgcatcctgaagcggataattttcaaacacaataatatgatcaatcagctttggctgatcggcctggctttggatgtcatagagcggcacatattgatgaggctcagactgcagcgattgctcctgcagctgcttgagcaagccgttaaatgtggtatcctcagacagcttcacccgcctcggaacagcattgataaacagcccgaccatatgttcaacgcctttgatttctgcgggacgcccggaaacgactgtgccgaagatcaaatcgccggactgctggtagcggctgattaatacactccaaaccgcctgcagcgccgtactcaaagtggtatgctgcgattttgcaagctcggtaaatgcttttgtttccgcctccggcagtgagaagagcagctctttcggctcatagccgttctcttgtttctttctttgctccgcaaatgtcgtttgtccttcaaaatcttctaagtacccgcgccagtaatgcagtgatgcatgtttatcctgcttttcaagccacttgatatagtctttatacggtttgaccggcggcaggctgtacggcttttgttctcgcagggcattgtataccttaaacagatcctgcacgacgatgccgaagcaccagccgtccaaaatgatgtggtggtagctccacacccattcaaagctttcttccgattttttaaagatggctgcccgcatcggaatatcccgcgtcaaatcaaagcccttgatcttatcctgttctttgtattcattaattttggatgcttgctcgctgcccgttaagtgtgtcagatcgatttcttctatctgaaactgccgttttttcaatacgacttggaccggcctttttactttttcgtgaatgaacacggtacgaaatacatcgtaccggtccatgatcacattcatgctttcttcaaggcatttgatattcaagctgccttttactttcattgtcatttgttcgatgtaaaagctttggccgggattcaggagagtatgaaacagcattccctcctgcatcggcgacaaataatacatgtcctgaacttgatcttttttgaactggctcatctgctccgctccccccttctgttaactgtttttgtcacgttaaattctcctcaagcatgtcaaagatgtctcccatttcatccatctcaagatcctgcgcgctgaaatcgctcggcgtaaattctttctcctctttggccgtgcaatggcggatgatcattaaaagattgtctttaaaccgctgcatctgtgtttcgacggtgcttctttcatattcttcctgattgtatgagcaggaaatgacgaagcggccgcctgtaaccatcccgctgaagctcagtgcgtataacgcctctgactcttcgctgacttgacgtcccatatcatatggagacggctcaaaccattccgttttcacttcattgtcaaactgccccaagtagttaaaactgatttcaggcgcggcgcctttttctgtttcatcggatgacagataccggagaattccgtatcctacacctttatctggaacgcgccgcactgtctcttttaccgttttaatgacggaagagacgccgtcttccttgctgatctgcagaatcaacggatattgggccgtaaaccagccgaccgtccgtgaaatattgacgttcggtatgatttcttcccggccgtgtccttctaagttgatgccgactttgccgttttccgtccattcaccgatcgttaagccgagtgcgctgagcagaatgtcgttgatttccgttccgtacggatgatgaacatctgtcagcagctgtgccgtttcttcctcagtcaattcacatttcacggccgccgtatgtttgacgagccgtttgtccggatcatggtctttcggcagcggccggagctcttccgcatctgcctgcgcccaataatccgcctgctttttcagctcttctgattgcgcaaacgtgttcagcgcctccgcccaatctttaaaggagtgggttttttgcgggaggacgatgctgttttgctgctgcgcctgtttataacctgaagcgaaatcctccagcagaattctccatgaaaccccgtccacgacgagatggtgaaccgcgattaacagatgatcgccttgttctgtccggtattgctccgcttttaacagcgggccgttctccagatcaagactgccctgaagatgatcggcaagccgctgaatctggcttttcagcatatcctcgtccgttccgtacagatcaacgatttcaaagcttgccttgcattctgtgacagggaggtatgtctgaatgatgccttccctttcttcacggtaaaccatgcggagcgcatcatggtgttcaatcaatgcttgcagggttttttccaccaggtccggatcaaagccgtctttcgcgtgaagcatgacggattggttccagtggtgtttgtccgtgaagtttttctcaaagaaccagcgctggatcggcgttaactccgcttcgccttcgacaggtccctggtcggcctgcttgccttccgtccgctccacataagagacgagctcttcgatggtcgggtgctggaagagatctttcatctccagcttgtagccgtgctggttcaggcggctcgccatttggatgcctttgatcgagtcgccgccgagggtgaagaaattatcgcttacgccgatctgatcaagaccgagcacttcctgccaaatgtcggaaagcagcgtctccatctccgtttccggcgctttgtaagcggcgcttcccgcttcaatgtccggttccggcagggcttttttgtcaatctttccgtttgcggtgaccggaagctcgtccatctccacccagaacgccggcaccatgtagtcaggcagcgtgtctttcagcgcggctttgagcgcttcaatatcgtcctgccgaggcgcgacataggcgcaaagcgcggtattgcccgctttgtcttccaccgccgtcaccgctgcgtcatgaacgtccgcaagctgggcgaggcggacttcgatttctgaaagctcgatccggtagccccgcactttgacctgctggtcgatacggccgatgtattcgatgccgctctgcgcgttccatttgacgaggtcgccggtccggtacatgcgctcgccgggcacgaacggatctgcggtaaaccgcttcgccgtttcttcctcacggttcaggtatccgcgtgccagaccgcggccggccacgcacaattcaccggcaatgccttccggctgcacctgatcgccgtcgccgagaatataagctctcgtattggcaatcgcccgtccgatcgaaagcgatccttcctcaggattgatgacgccgcttgtcgcgacgacggtgttttccgtcgggccgtagttgttgacgatcgtgtacggctgtttcaccgcccgcttcagcttgtcgccgccgacgagaagcatgcggagagaggtattttccagctccataaattgttcggccagctgcgtcggcaggaaggtgatggtcacgccgtgctcctcgaaatagtgatttaagcgggtgatatccagccggatcgcttcgtcaatgacgtgaagctccgcgccgatggtccatgtcgggaacatctcccagatggaggcgtcaaaaccgaagcccgcgtatttggcgcttttatcatccgccgtcatggcgaatgcgtcgtgatgccagaagcacaggttcaccagcgcatggtgttcgaccatgacacccttcggctgtccggtcgttcctgacgtgtaaatcatataagcgagatgatccgccgttgtttcagtctgcgggttcgcttcatcgttttcatcaagcggcaggctcagaatggagcgtccgccgtcaagcaggatcgtttctcctgtgtagccatccggcacgtccagcgcttcctgtgtgagaagaagcttggcgccgctgtcctgcagaatgtagctgatccgctcttgtgggtagtcggggtcaatcggcacaaatgccgcgcccgctttcaggacgccgagtacgcccgcggccatttccaaggacggtttcgtcaaaatgccgacacgttcgtcagccgtgacgccgcagtctatgagaatgcgcgcgatccggttcgcccttgcgttcagctcgccgtacgtccatttcgcgccgttatatgccgcggccggccggttcgcgtatcgggcggccgtttcttcaaagagacggtgaaccgttttgtcctgcggcacagagagtgtttttcctttccatgcgtcaaggagggcttgtttttcagcatcgctgatcagtgaaatctcaggcagctttctgtccgggctttccgccgcttgcttcagaatccgcaggaacccggcgctccacttttcaatggtttcttttttaaacagatcagtcgcatattcaaactgaaggccgagaccttcttgatccgtaaagccgccgagtgtcagatcgaatttcgccgtgccttggtttgactcatacggagtgatgcgcaggttctccagttccagtgtttctttatccggatcttctgtcgtcaccatcacctggaacagcgggttgcggctcatatctctcggcaggtcaagctttccgatcagatcctcaaacggataatcctgatgcgccagcgcgtcgagattggtttgtttcacccgttcgagcagcccggcgaaggtctgctctttttgcgtttcattgcgaagcgcaagcgtattgacaaacatccccggcatttcctgaacttcggcgctcgttcttcccgcggtcaccgaaccgataatgatatcgcgctgtcccgtgattttgctcaaaaagacatggaacgcggcgtgaagcaccatatgaagagtcgctcccgatgattccattaattcacgcaccgctttttccgtctcacgccccgctctgaaacggacggattgtcctttaaaactttgaaccggcggacgcggaaaatcggtcggcagattcaattcaggaagctcgccggaaaatgccgagagccaataacgctcatggtctttcatccgttcggcctgcccgggttcattctgccagacggcgaagtctttatagtgcaggttcggcgacggcagacttccgcctttgtaaaggtgagcgagctctttgaccagcatgcttctggacacgccgtcggcaatgatatgatgcatatccagcagcagcaggtgtttcttttcattcagtctgacaagagcggcccgaatgagcggagccgcgctcagatcaaacggcttaatgaatgcctgaatgataagatccgccttctcctcgtccgctgcttcaaaaatgtgcaggtcaatgtcagcctgttctgcgatctgctgcatcggctggcctttttgatcgataaaggacgtccgcaaagattcgtggcggttgatcatctgattgagcgctttctgaagccttgaaatattgacttctccttccatcagaagaacggacggcatattatagctgattgtctcccggtcaagctggttcagaacgtacatccgtttttgggcggatgataacgggtacgcgtctgcactgtctgccggtgtgatcatccgatatccctcagataccgccgatttttcgatatatgcggcaagcaggcggacagtcggctgttcgaacagcgcttttaacggaaccgttttgtccagttcagcctgaatattggcgaggagcatcattccttttaaagagtgcccgccgtaatcgaagaaattatcgtcgatgccgagcgtatccgtaccgagtgtctgtttccaaatgcggcacagcttttcctccaattccgtttccggcaaggctgaagcaatttgcgccgtttggctgacgcccggtttcgggagggcgtttttatcggtttttccgttggctgtgagcggaatgcggtctacttgcacgaaataggccggaagcatatgagacggcagtgtttcggaaagccgtttgcgaagctcagagcctttcagcccgctgtcggctttatagtacgcgcacagttccggcagcccgccttcgctgactgcgagaacgaccgcctcctgaatgccgtttacgcttaacagcacggtttcaacctcttttaattcaatgcggtagccccggattttcacctgatcatccgcacggccgataaattcaatcgtcccgtcaggaagcctgcggacgatatctcccgttttgtacatcaggctgtccggtgaaaaaggttttgagagaaatttctccgccgtcagctgcggacggtgaagatatcctctggcaagccccttcccggtaatataaagctcgccgcttgcgcccggaggaacgagctgcattgctccgtccaatacaagcgcgccggtatttgcgatcgggcggccgatgacgggacgctgctcatattgatcaagacgctccatattgatccgttccgcaatggcgccgatcgtcgtttccgtcggcccgtagtgattgatgaagtcggtatgggcgtatacgtcatgaaacttgcggacatcggacgtgatgatcttttctccgccgagcaccactaaacgaagcgagctgaaacggcgttctgacgtaaaacgggctgtattgacgatcatatggaacaatgacggcgtcagtttcatatacgtaatgccgtttttctgtatatactcaccaagctgatcaggcgcggtgtacgtctctttcggcacaatgtgcagctcgccgcccgcctgaagaatcgggaatatggccgtatagccgagatcaaatgcgtaagaagacagcagcacggatttgtcagcttcggtcaaaccggcttcacggctgaaccatgtgacataattgattagattgcggtgttccagctggacgcctttcggtttgcccgttgttcccgaggtataaatgatataggcaagccggtcggcgccggactccgtttcaagccggtcggcgctttcgttctgccattctccgtcttccattacgaccgtttttcctttataaacggcggccgcggtcatgtttctctcattgacgaccagaagcttcgttccgctgtcttcgagagagtagcggattctctcttcaggagtctccggatcaatcgggagaaatgccgctccggctttcatgacgccgagaatcgcggtaatcaagtcggccgaacgatccatcataatggccacgatgtcctcactgcccgttccgcaagcctgaaggtgtcgggcaaaccggttcgagcgttcatcaagctcacgatatgtcagacttgttccgcccgcaaccgccgtgagatcaggcgttttctgcgcttgccgttcaaacagcgaaacaaaagtgccctcaggcagatccgcttccgtccgtttttcatcagaaaggagcgcttcccgctcaggagcggacagcaggcttgcgtcggccagctgaatatccggattttcggcgcaggctttaatcagattgacaaaatgagcgctccagcggcggatggtttcgtccgcaaataaggctttcgcgtaatcaaagctcaatccgacctcttctccgcgctcagccgcttctaaggaaagatcaaatttagcgacatgatgatgcatggagtaagaagaaatctccaaatctccgagccgcagggccgggatctccatgttctgcatattaaataacacgctgaacagcggactccggcttgtgtccctcgttaacggcagtttttcaattaattcttcaagcggatagctttgatgctcaaaagcttgaaggctcgccgttttcacttcatccagaaattgcttgaacgtttttttgccggcaggatgcgaccgaagcgcaactgtgttgacaaacatgcccggcacgtcttggagatcaggatgctgtcttccggccgccggagacccgactatgatgtcttcctgccccgaatatttggacagcagcacttgaaaagcggctaacaagaacatgtacatcgtcgtatccgtatcagccagcagcttcttaatctgcgccgtcacctgtttatcaagcccgaagatgacgcgttccccttcaaaactgcgctcggcaggacgcgggaaatcaagcggcagatccagcaccggcagatcgcctttgaacgtatcaagccagtaagcttcgtgctgatcaagatttgctttttcacgctgccagactgaaaaatccttataatgaatctttggcagctcaagctccgtgccttgataaagcttcgcaagatcaccgatgaaaatgcccattgagcttccgtccgtaataatgtggtgcatgtcaatcagcagaagatgccggtcttctttaagccggatcagcttcgaacggaccagcggcgcacgattgagcgcaaacggcctgataaaggcttttgtcagctcttctgcatcttcttcccggccctcggcggtttcaagctcaaacgacacatttttatgaatggtctgcacgacttctccatctgccatgtcaaacgacgtacgcagtgtctcatgacggttgattaatgcctgcatggcctcttcaagacggtttttgtctactgatccttccagcagaagtacagcagggacgttgtagctcgtgctggcctgtccgagctgattaaggatatacatcctgcgctgtgctgaggaaacaggataatgcttctgataaggcgcttgtcggatcggttcaaactgctgttcctcctcggtctcatgctccaaataatgcgcaagctcctgaatggtcggcttttcaaataacactttaatcggcacttctttttgaaagtgctcctggattttagcggtcatcatcatggcttttaaagaatgtccgccaatcgtgaagaaattgtcagtcacacccgcttttacaccgagaatgccttcccaaatgtccgcgagtttctgctccgcttccgttttcggcgcttcgtattctttttgaacggcttcagcctgaggctcaggcagcgcttttttatcaatctttccgttcgccgtcagcggaaactgattcatctggatgaagtgcgcgggaatcatgtattccggaagtgattccgaaagcgttttgcgcaggtcttccggcgaaagggcttggtctgcggtaaagtaagcgcagatttcattttcatccgctttatttttccggatcacagccgcagattccgtcacattctccgcctggctgattttcgcctcaatttcgccgagctcgattctgaaaccgcggacctttacttggttgtcaattctgccgagaaactcgatcgtgccgtccggaagccacttcgccaagtcccccgtccggtatatcgtttcatccggtctgaacggatcgcggacaaactgcttctccgttaattcaggcagattcacatagcctcttgccactccgcttccgccgacacacagctccccgggcgcgccgatcggctggaggttgcggttttcgtccataatgtacgcagtggaatttccgatcggcttcccgatcgggatcgaaccgtcgtagtcctgatcaatgagaaaactcgtcgaaaacgtcgtattctccgtcggcccgtagccgttccaaagcgacagctccggtgatgccttcctcactttgctgacgatatgcggcacaagcgcatcaccgccgatgatgaggtgccggagcgtgttaaacatgccggcatccttttgggcaagctgattaaacagcggagacgtcagccacatggtcgtgatccgctgctctttcagaaattgggcgaatcgtccggcgtcaagcagcgtctcttttttcaccgggtgcaatgccgctccgttcagcaatgcgccgaagacttcaaaggttccggcatcaaagctgacggctcccgtttgcgccatccggtcttcttcatgaaccggcacgtaattcgaaggtttgacgagcctgatgatatttctgtgttcaatcatgacgcctttcggtttgccggtcgatccggatgtatacatgatatacgccaagtcgttgccgccggccgggagattcaagtctgttccgcttaccgtttcatccgcgctttcattcagcatgacaatcgggacttgcaatgtgcccgcttgttcttgatagtcctgaactgtcagcacgagccgaatcgagctgtctgccgccataaagcggagacggtcctccggaaaagccggatcaatcggcacataggcgccgcctgcttttaggacggcaagcattccgataacggtttccgcagaccggtcgttcataatagcggcggtccggcctttttccagcccgctcttcacaaggtgtctcgccaggcggttggccgcttcgttcacttcacggtaggtccattcgcgtccctcttcttttatcgcgatgcttgcaggcgtccggtttgcctgtgcttcaaacaaacggtgaacggcctcctcttccggaagcgccgttttcgtatcattgaatatctcaacaatctgccgctcttcttcgcctgaaacaaggccgagttcccgcacgggcgcgtcaggcgttccgaccgccgctttcatcatgcaggtcagatggtgcgccgttcgttcgatggcatcatgtgcgaaagccgctccgttgtatttgattttgacggtccacgtttttcccggatacacgatgagattgaaatcaaagctcgtctgctcaaaagcatgttcaactttaatggaaaagccgagtctttcctccatgcccccgttttccagctctttgtccagcggatagttttcaaacgcgaccaaatgattcaagaggctgccgtccagagcggagcgcttttgaatgtcatagagcggcacataatcatagcgctcggcttccacggcgtttttctgaactgccgccatcacgtcagaaaaggctgcatctttgtcaatcttgattctgacaggaatcgtattgatgaacagccccgccatcgtttcaatgccgttgatttctgaaggacggcctgatacgacggtgccgaacaccacatcgtctgtatagttgtatttgctgagcaccgcaccccaaacggcctgaaacaggttaggccccgtgacttgatgccggttggcggtctgctgaatctgcgcgaccagctcttcatcccagacaaaagaatattcttcattttggtagtctttcttttctgatgccagacggcccgggagcaggctcggctgttcgaaatccgccaggcggctgctccaatattgttccgcctcctcataatccctgcctccgagccatttgatatagtcagagtaaggtttgccctggcttcccccggcgggccggccggcacgaagcgcttcatagttttgaaacaggcttttcatcaaaacgcccatactccagccgtccatgacgatatgatgattgctccagacgagatacagttccttctcactgagcctgaacaccgccgctttaaagagaatatccttcgccagatgaaagccctgctgctgcacatcgcgtttatagcgttcaatatattcggtttggcgcgcttcatctaattgactgatatcttcatagtgcaccttcgtcttccgctctgctaatacgacttggcgcggtttttgaagctgctggtgcacgaataccgtacgcaggatgtcatatgtccgaatcagctcattgacacttttttcaaaaagctcaagctgaaagcttccgtgaatcctaagctctaattgtgtgaagtaggaggaagaatgcggatcaagcagcgcatgatacagcattccctcctgcatcggtgtgagtgcatacaccttttgaatcgattttttgctcatatgtcacctctgtcttttctgttagagaatttccattaatttatcaagttcatcaagcgtcagatcatcatcgccaagatcgctaggcgtaagctcaggtccgtcttgggccaggcagtgatctatgattttcaagaggtgccctttaaagctgtcactgaacgattgaatggttttttcatgaaattcgagagaatgataggcaaacgtcatcgtcatctgcccattttctataaatccgacaatatcaagcgcattcggcttctctgtgtcagggctcagcgattgtcctgacggcatcccggatcttgtaaataagccggaatccgacatctcattaaactggcctaagtagttaaagctgatatccggatcaatctcaaatgaaagaccctctttatgctcaggcgccgttacataacgcagaatgccgtagccgactcctttgttcgggatgtgtctgatgtcttctttcatttgtttcagctgatatgaaagatcgtcggcgtgcttcatctcaaggatcatcggatacatgctcgtaaaccatccgaccgtccgggtgatattcaggccgtcaagaatgtcttcgcgcccgtggccttccaaatgaacgccgatcgtgtcttcacccgtccactctttcagcgccagtccgagcgccgtgagcaggatgtcgttcatttccgtatggtaggcttcatgtacgtttgtcgtcagctgttcagtttgttcaggcgtcagagagaaactgaccgttctcgtatgtctcatgcgctgatcgccagactgcctgtctttcggaagctgagtgcatacctctttctcctcaagccccctccagtaatccgcttctttcagaaacgccttcgtatttgcgtattctttgattctctcagcaaattcggcgaatgaatgtgttttcggaggcagcgccggttcattgccttgtttcagctgcgtataaacggacgtgaagtcctccagtaaaatccgccaagatacaccatccacgactaagtgatggattgcgagaagaaggtggtctccatcttcagcccggaagagcccggccttcagcagatgtcctgtttccagtgaaatactgctttgaagacggtctgcttcccgttcgatacggtcctcatgatcttcagcaggtccgttcagctcaaagacgttcagttcaacagacgcatcctcaagccctctgtaatacggtttttgttcacgataaatcatccggagcgcatcatggtgcaccgtcaggacatgtaatgttttttctgttatctccggatcaaagccgtctttcgcatgaagcatgacggattgattccagtggtgtttgtccgtgaagtttttctcaaagaaccagcgctggatcggcgttaactccgcttcgccttcgacaggtccctgatcggcctgcttgccttccgtccgctccacataagagacgagctcttcgatggtcgggtgctggaagagatctttcatttccagcttgtagccgtgctggttcaggcggctcgccatttggatgcctttgatcgagtcgccgccgagggtgaagaaattatcgcttacgccgatctgatcaagaccgagcacttcctcccaaatgtcggaaagcagcgtctccatctccgtttccggcgctttataagcggcgcttcccgcttcaatgtccggttccggcagggcttttttgtcaatctttccgtttgcggtgaccggaagctcgtccatctccacccagaacgccggcaccatgtagtccggaagcgtgtctttcagcgcggctttgagcgcttcaatatcgtcctgccgaggcgcgacataggcgcaaagcgcggtattgcccgctttgtcttccaccgccgtcaccgctgcgtcatgaacgtccgcaagctgggcgaggcggacttcgatttctgaaagctcgatccggtagccccgcactttgacctgctggtcgatacggccgatgtattcgatgccgctctgcgcgttccatttgacgaggtcgccggtccggtacatgcgctcgccgggcacgaacggatctgcggtaaaccgcttcgccgtttcttcctcacggttcaggtatccgcgtgccagaccgcggccggccacgcacaattcaccggcaatgccttccggctgcacctgatcgccgtcgccgagaatataagctctcgtattggcaatcgcccgtccgatcgaaagcgatccttcctcaggattgatgacgccgcttgtcgcgacgacggtgttttccgtcgggccgtagttgttgacgatcgtgtacggctgtttcaccgcccgcttcagcttgtcgccgccgacgagaagcatgcggagagaggtattttccagctccataaattgttcggccagctgcgtcggcaggaaggtgatggtcacgccgtgctcctcgaaatagtgatttaagcgggtgatatccagccggatcgcttcgtcaatgacgtgaagttccgcgccgatggtccatgtcgggaacatctcccagatggaggcgtcaaaaccaaagcccgcgtatttggcgcttttatcatccgccgtcatggcgaatgcgtcgtgatgccagaagcacaggttcaccagcgcatggtgttcgaccatgacacccttcggctgtccggtcgttcctgacgtgtaaatcatataagcgagctgatccgccgttgtttcagtctgcgggttcgcttcatcgttttcatcaagcggcaggctcagaatggagcgtccgccgtcaagcagaatcgtatctcctgtgtagccatccggtacgtccagcgcttcctgtgtgagaagaagcttggcgccgctgtcctgcagaatgtagctgatccgctcttgtgggtagtcggggtcaatcggcacaaatgccgcgcccgctttcaggacgccgagtacgcccgcggccatttccaaggacggtttcgtcaaaatgccgacacgttcgtcagccgtgacgccgcagtctatgagaatgcgcgcgatccggttcgcccttgcgttcagctcgccgtacgtccatttcgcgccgttatatgccgcggccggccggttcgcgtatcgggcggccgtttcttcaaagagacggtgaaccgttttgtcctgcggcacagaaattgtttttcctttccatgcattgaggagggcttgtttttctgtttcattcaccaaggaaagctcagaaagcttcgcagccggattttccgttgcggcttttaacagttgaagccaataatgcttccacgtctctgccgtttccggtttaaacagcgcggtgttatattcaagcacaaacgttaagccttcgtctgtgtcctcagccgtcatcgtcaggtcaaacttggctgtttttctgtcaaacgggtggtgcttcagctcaattccttccatgaccagatcttcagcatttgcattttgcattgagaataccgcatcaaacagcggatttcggctcgtatcacgctgcacctcaaccttttgcagaaggtcttcaagcggataatcctgcgcgtcaaatgcatgtaaagcggtttgtttcacttctttaagatagtccgtgaacgttttgtccgcttccggatacgtacgcagcgcgagtgtattcacaaaaacaccgatgacgtttgcgagatccgcatgtgaccgtcccgcaaccggcgagccgacaatgatgtcatgctgtccgctcagttttgagagaaaggcgctgtacgacgccagcagcaccatgtacatggtagaatccgtttgtttcgcaagactgcgaagagccgacgtctgttcctcagtcagagaaaagaccagcttgtctccttcaaaggtttgcacggccggacggctgtaatcagccggcagcgtcaataccggaagctcgccgtcaagctcccgaagccaatgctcctcctgcttgcggtactgctctgattgaataaatttctgctgccataccgcatagtctttataatgaatccgcagcggctcaagcgtttcgccgccatacaagcgggacagttcatctatcagcacgccgactgaagcgccgtccgaaatgatatggtgcatatcaaacagcagcaggtggtcatgttcagccagcttgaccagccccgttctgacgagaggaagctgatccagacggaacggccggataaagctctgaataatccgttcagcatcttcttcagaggcttcataatattccatgtcgatataagcttccgcccatatacgctgaaccgtttctccatcctttatgtcaaatgtcgttctgaaggcttcatggcgttctgtcagctgtttcatgacggatttcagcttttctgcatcaagctttccttttaaacggagcacagacggcatgttatagcttgtttcagcgccttccagctgctgaagcacgaacatccgcttctgcggtgaagaaaccggatacgtttcccgctccgcagccggtgcgatgctctcagccgccttccgctcagccccttcaatcagctgcgccagcccagcagccgtcggagaagtgaacagatcctttaaggtaagctgcacgccgaatgtcttctggataagggccagcagtttcatccccgctaacgagtggcccccgatctcaaagaactgatcatggacgccgacccgttccatttgcagcacctcagcccaaatatccgccagtttttgttctgtttcattgcgcggcgccgtatatgacacggcattcgctgcggtcacatccggcatcggcagcgcccgcctgtcgatttttccgttccctgtaagaggcagttcatccaattgaataaagacggacggaatcatataagccggaagatccttcgccgtatgctccctcagctcccgggaagatatttccctgaggccgacaaaatacgcgcaaagaagtttgtcacccgcgccctgatccacagcgagcacaatgcattcctgaatctgatcatggctttgaagctgatgctcaatttcgccaagctcaatccgctgaccgcggattttcacctgatggtcgatgcgtccgataaactcgatatcgccattcggaagccatctggccaagtcgcccgttttatacatccgttcaccttccttaaacggatgctttacaaatttttcttccgtcagttcaggacggttgtagtagccttctacgagaccttccccgctgacgcacagctctcccgcgatacccgccggctgaatgcgtccggctgagttcataataaagacttccgtattgctgaccggtttaccgatcggaacggagagcgtatcctcttcaatgacatccaccggatggtatgtcgcaaacaccgtgctttccgacggaccgtacatatgaagcagttttcctttcccgactgccgccagcgcctttttgacatgttctacagacgctctttcgcccccgaacatgattttccgaagcgtcgtcagacaggacggctccatatcaacaagcaggtggaacagggccgtcgtaatcatcagaatgctgacgttctcccgtttgatcacacgggacaggcgcgacatgtccagcaccgtatctttcgggacgatcacaagctttgcaccgtttaacagcgaaccgaacatatcaaacataaaagcgtcaaagacgtagtttgacagaccgagcactgtgtcctcttcagaaacggtcaaatagttcgtgttttttaccgtccgcaaaatgttggcatgtgtgacgatgtttcctttcggcgttcccgtcgtgcctgatgtatacgtgagattggcaatcgttttggaatcaaacggcaatgctggattgcgagagtccttttcatagctcgcctcatcatcagcaagcacaatgacgccttgaaaaccggccttttccgcaagcggcttgaggctttgctgagtcaggagcacattcgccccgctgtcgcggaagaaatgctgaatccgctgaaccggatgctcaggatcaatcggcacataggcggaccccgcttttaacacagccataatggaaacaatcatgtccattgaccgttcacataaaacagccgcggttttcccgccgcctccgaccgaaagaatatgccgcgtaagcctgttggcgcgttcattcagctgctgatacgacagagtttccccttcgaactgaagagccgtccggtcagggttctttcgggcctgttcttcaaagatctgcacgatcgtttgctctttcgggtatgccgtgcgctccggattgaaccgctgtaattggttcaaagcctcccgttcagaaagcagatcatattcgctgattttcgcatccggctgagctgccgcactctccagcagacggacatagtgcgcaagcatgcgatccgcagttgagcgcttaaacagcttcgtgcaataatccaaatcgagcgcaatgccttccgctgtttcccgggcctgcattgtcagatcgaatttagcgatattgaagttggtttcatgaagagacagcgtcaggttgccgatctccggaattccgtccgaagcattttgcagactgaacatcgtgtcaaatatcggatgcctgctcatgtcccggggcacgttcagctcctcggtcagccactcaaacggataatcctgatgggaaaacgcgtccagcacctgtttgcgcacatgacctaacaagccggcaaatgtctgatcctgcttcacggagcttcgcagcgcaagcgtgttgacaaacatcccgataagcccctcggtatcagagtgatttcttcccgctgacggtgttcccacgatgatgtcttcctgtcccgaatacttagaaagcagcgtatagtatgccgataacagcaccatgtaaagggtggctccgtttttctcggcaagcttctgcagccgttcccgcagcattttcggcagcttggcggacacgcggtcaccttcaaagctttgcacctgcggccgcggataatcagggagcagctgaagcaccggcagttcgccgctgaagacttctttccagtacgcccgctccttcttgtagccttctttcgcccgttccgcctgccatacggcataatctttatattgaatgcgcaattcaggcagctgatttccgccgtagatgtcagccagttccttcagcatgatggaaatagacaccccgtcagaaatcaggtgatgcatatcaaacagcagcatatggcgattgtgaccgagcgtttgcaggccgattctgaacagcggcgcctcagataaatcaaaacggcgcacaaagtccttcatgacctgttcattcgttcttccgcgcgcttcgagcatttcaatatgaaacggaacatgttcgtgaaccacctgtctcggcgtgccgtcctccgattgaaacgatgttctgagcgcttcatgcctgctgattaaggcagaaaatgcacgctcgagcttttcaaggtctaaagcgccctcaatcacggccgcagccggcatgttatatccgactcccgcatcttcaaattggctcgcgatataagtccgctgctgagcgagcgaaagcggatagctcgcctgcttctcagccggctcaatcgccctgaatgccggtccttcgtttcggttttccgcataatcggcaagcgccgcaatcgtcggatgctcaaacaagtattgcagcggaatttcaacgcccatttgcttatgaattttcgtcagaagcgtcattgcctttaatgaatgaccgcctgactcgaagaaatgatcataaatgcccgccttgtccattccgaggacttcctgccagatgacggtgagcgtttcctccgtttcgtttctcggcgcggcatattcggatgagctgacagcctgcacatcaagcgcaaacagctttttgcggtccgccttcccgctcggcgtgagcggaatttcgtccgtttttgtaaagtaagcgggcaccatgtaatcaggaaggtgcttggacacatactccctgtactcggcagggtgaaactcggttcctttttcctgaacgatatatgcgcaaacatctaagctgccctgctgatccggccgtgccagcacgacggcctgcgccgcccccggagcttttctgagcaccgtttcaatttctcccagctcaatacggtagccgcggactttcacctgatcatcttcacgtccgatatattcgatcgtcccgtccggcagccagcgcgccatatcacccgtgcggtacatgcggccgcttccgttaaacggatcttgcaaaaacttctctgcggtcaaatccggaagatttaaatagccgcggcctacaccgtcacccgcgatatacagctcaccggccgtgccgtcgggctgaagccgctggtgcttatccaatatatacagacgggcgttgccgagcggttttccgatcggaacgtacgccgcctgttgattcattccgttatcggcggacacctgatgcacggacgcatctacgcacgtttctgtcggcccgtagacattcgtcagacgcggcgccctgcccgattgatgaaagaggttcatcagctgttcagcaacagcggcggacaggccctctcccccaatgagcatgtggcgcaattcaattccgctgacatctcccgccgcaaccatcatctgcagatgcgcaggggttccgtcagtggcttcaattcggttttgacgataatagtccagcagtgccgagccattcgttacagtcgttttcggcacgatataaagcgtctgtcccaaaagaagcgaggcaaaaatctgtttgacggacgcatcaaaatgaaacggagccaaaagcgccattcttaatgtctgctcaccgcattgataaatctcctgctgcagtgattgcaccagatgatgaacttgccggtgctcaatcatcacgcctttcggccgccccgttgtacctgacgtgtagatgatgtaagccagccggtctgattgtgtactgacaccgtccgcagccgtttcaaactgaacagcctcgtcaaaatcaatccgttcggcatccgctgcaggcgcctgtattccggcctctgtcagaacagccttcgctccgctgtcctccaaaatgtactgaatccgatccgccggaaagtcaggatctatcggcacataggcgccgcccgctttcaaaattcccaatattgccgcaataacacgctcagaacggccaagcagcaccgcgacaggagaatcggctgatatcccggctttaagaaggcgtccggcaattcggcctgactgttcatgcaatgtgcgataggacaatgttcggccttcatacaccaccgccggtttgtcagacagtgacttcactttctcttcaaacagccccggtatcgtcatctccccgcggtaattcaccggattaccggaggcccgtgtcagcagccgctctttctcggattcagaaagaagagtaagctcatcaattatgcgatcaggagatgaaatcgcatcttcaatcagcgtgatcaaacgttcagaaacagatacaatctcctctcccttgaatatgtcgctgcgatagtcaaaatcaatcgtcaatttcccagtgtcccatcgttccttcacatgaatcgaaatatcatttgtaccgcttccgctgaaaatagggtctgtcaggaaggacagattctcttttttctgccactgcatcacctggtactccagagccaccgtaaacaatctgctcagcgaacttttcgaagcgcgcaaatcattgacaagcaggttatacggatacttttggtggcggagaattttcatcagatccttcatccggcctttaacgaattccaagaacgactgtcctccgtcaacgcttgtccgcacaggaaccgtagatacgaacatcccgagcatctgcttttctttcgcattcgtccggtttcccataaacgtacccgtgacaacgtcatcccggccggtcactttgtagagataagtgatcaaagctgattggaacagagatagtacgctgactttatgctcctcgcagaatgaatgaatgcggccgtataagtcgtgaggaatttcttgagaaaaccgtttcgcatcaagacccgcatctgcctggctccgtttcagggacacaagctccggcacggtctcgaactgcccgttccaaaaatcccgatcctttttaaaccgcttcgactgcacatattcctgctcagtcagcacatgctcgataaaggaaggaatctccgtctgttccatacttgctccgcccgaaagctccaaataaatatcagtaatcgcattgcccagaatcgtcatggaaatcccgtctgaaataatgtgatgcacattaacgtaaaaccagacctcattttcgctgatggtatacacggaaaaacggaataaatcctgatcatataatgccagaggcttgcttgcctcgtcacgtccccattttgacagctcttccgcagagcagccggcttgcctgatgtctgtatgttcgatagtcagcggacggtaatcgctcacatattgaacgggctccccctcatcatcaagccgcagacggattctcatcgactcataccgccggacgaattcctgtatcgctttctcaacgtaatgagcctgtacgccgtcgtcagaaatgagtttcccgaacccggcaagatttgaaatacttgtgttcggatagaatttttctgtataccagatacgtttttgagcatttgttaaaggataaaaagttatttccatatgtgtgcgcctcccctttttaagataaaattgtcaattctcccttagaaacagcctccctcaatgtccctaactcattatcaagccaaaagaaccacttacctccaaaacgatcccgattcaatcaccgccgaaatccgcaatccactcacccgcacagtccgaaatgcggctcaaatttatgagaaatcaagacaagaatccaatgtttgtaagcaacagggtttacctatttcttcatgaattactatatatctacttacgttcactttatatgaaattattgtttttatcaccgaaaaatgggtgaaaagtttcattcggcacaccgaaaaaaattccgacaattccagagggtattttgcggcatcccgcaatttatttttaaaaatattatttatgtaaaattaaaaatctttaaactatagtataaatctctcgaatatccagttatggcagaatgaaaatagttttcatatatgagctgatggggaaaaaacagcgcaagaaccgaaacaggagatttaatcgttcgcaatatgatttcattaaaccgcaaaaaaagcactctattttacatagagcgcttcaaaaagattcctttattgcagttttatcaatgttgattaattccatatattcttttccccacttatacatggcgtccaaaatcggcataagggtctctccttgctccgttaatgagtactccactttcggagggacgacagggtaaacctccctgtgaacgatcagatcctgctccagctccctgagctgattcacaagaattttgtgcgtaatatccggaattaaagctttcagctcattaaaccgctttgttccttcttttcccaggtgccacataatcagcattttccacttcccgcctatcacggcaagcgtcaattccttttcgcaattaaacgttttctcatccattcggctcacgggccattctccttcctcttactttttgtacgttcatcatctattcatacacgcttacttttttacacaactttcatcagtttatactaccacgcagttttgctgaaacaaagcgcattgcctgcggggacagtatcctcaaagtaactattagacttcaaagtgcgtacttctcaacatgcggggcactctatagaatgtaaatacatgaaaaagaggagtggatataaagtggaattacagctggcattagacttagtgaatatcccggaagcaattgaacttgtgaaagaggtcgaacaatatatagatgttgtagaaatcggcactcccgttgtcattaatgaaggcctgaaagccgtacaggaaatgaaatcagcctttcctcacctgaaagtgcttgccgatcttaaaatcatggatgcaggcggctacgagatcatgaaagcggcagaagcgggcgccgacatcatcaccgttttaggagcgacagacgactcaacgatcaaaggggcggttgccgaagcaaaaaaacagcagaaaaaaattctcgtcgacatgattaacgtaaaaaaccttgaaacacgggcaaaagaaattgaccaactcggtgttgattatatttgtgttcacacaggttatgatcttcaagcagaaggaaagaattcattcgaggaactgacggcgattaaaaaagcggtcaagagcgctaaaaccgcaattgccggaggcattaaacttgatacgcttcctgaagccatcaaacaaaacccagatttaatcattgtcggcggaggcattacgggagctgacaataaagcggatgctgctgctaaaatgaaacagctgatttcacaaggatcatgaaaacgactgaatacttacatgaaatactcaatgaaatatcccgcaccgcagcattaatagccgacagtgaagctgacaagcttgcagatgagattttatcggcagatcaaatcttcacgtccggagcggggcgttccggctttatggctaaagcgttcgccatgaggatgatgcacatcggcctgaacgcttacatcgtcggtgagacgcttacccctcccctccaagaaggcggtctcgtcatcatcggctcaggctcaggcgaaacaaaaagtctgcttcatacagctgaaaaagccaaaagccttaacggcatcatcactgcattaacgattaaccccgattcaagtctcggcaaacttgcggatcttacgataacgattcccggctctcctaaggaagagaccggcggagacagaaagacgattcagccgatgggttctttattcgaacaaactcttctgctgttttacgatgcggttattctaaaaatcatggagaaaaaagaactgaattcagcagacatgtttacaaagcatgcgaatctggaatgatttactgacggccttcttatcagatggccgtctttttatcgtcttgttgcgcacggtcatgcaggccaaggttttcgggtcggacactcgcagacgaagatatcctgccggtgagcttatcgctataataagtcaattgacgatacggccgcaaccgttcatttctgaatagggaaacggcaaaaaacactttctgatcggatatttaatgaataaaattgatttgtgcggatggttttacagatattcagctgaattgcggctgagaaatatattttaacagctttacagccggccgattctgctttattcttggaccagctttacagcaatttaaaactggaggtgattgatactcttgaaaacattaaaagcactgctgcttgttcttatcatcattgccggagcagtcgcggccctgatcaagggtgatcttttctcagataacgagcagaccgttcagaagagtgattacgacaaagtaatcctatttccgtccgatcgatatccggaaacagcaaagcatattaaggacgcgataaaagaagggcattccagcatatgcaccattgacagagacggagtacataagcggcgtgagcaatctcttaaacatgtgcctgtcaaaacgggatacgatagggatgaatggccgatggcggtttgtaaacagggcggaaacaatgcctccgtagaatatatttctccggcagacaaccgcggagccggctcttgggtcggacaccagcttaccaatgatcccgacggaacgagagtattatttaaaatcaagtaaaaaaacaggaggaacagcgcattgaataaatcatggaaaccgcaagaactggccatttcgtatcatcaatttacaatcttccaaaaagattcagaaccgcctgttatcgattggaccgatgaagccattgaaaaaggatatgcggaagctgacggagctgtttcattcgaagcaaggagaaatacgagggcatttatcgtcttcaggcttaacacaagtgaaccggtactatcctatgagaaaaaagcgactgttccctttgaggctgtaaaagatggaattgagattgaaagcgtgatgtcaaagcggcttttctttaatattccgaaaggccgatacagccttacctgttattcagtgcctgccgaaatatccgatcttcatgcggatacgtatattattgatgcagacgcaatgtaaaagaaacccctgagagaatcatatttctctcagggaacttttataaacttttaccgtttgtttcaattacattctggtaccaataaaaactgttttcctgatccgtttcaagtctttttcatcttcttcatctcgattgatatacacaaaaccgtagcgtttttgatagccgttcagccagcttaaacagatccgtgaatgaccagctgcagcagccgatgagatgaactccgtcactaatagcctctctgcacagttcacccatactgaaggtcctttaccgtcttattccaagctccttcaacctgataggcagccgaagctgacccccatagaaatgtatcagggaacagaccctgttttttatgtatcatgtgtttcatcctcctgatgcgtatgatattgatatcatacgttttgaaacgcatttcagagcaatcccgataaaaacaaaaaagcatccggcttgccggatgcttaagaatgatgatgccgcttttccaatttatgaggcggaggcttcgggacaaagccattttgtttcatcatattaaagcgcctgtccatatgctgtttaatatgttctgctttttctttcggcaggaccccgtactcaacatatttggatatgacatgtttgcgtttttcgagcacttctttttcaagtgattcaatttcttttttctgctgttccgtgagtgacattgttgaaggcatttttgtttcggcgtgtgccggcattgtgaaaaccattgctgtaatgaaaaacgcagctaaagacaatgcagcttttttcatgactctttcctcctttaacgtttgttatatgttgctccctcatccattttttatgcaaaaaaagagcgaaattattcgctcttttcaatcgattcgtccggcagtgcgtatgtgacatacgttcccgctacaaaatcgtggattgaccgtttgtcttctctcattccgaccatgaatgcgctcacgatcacaccgattccaaacgtcacgccatatatcaggccgcccacaagcactctcaaaatcatagtaagaaagcctgcctggtttccgtcttttttgacgatgcggataccgcagatctttttgccgataacataaccgttccagtatacagggagcaaaataccataaagagtcaaaatgatgctgatcattgcgctctcattcgggtcttttcctgttgccagcataaaaataatcgccaaaggcactgaagtaattaaatagtcgagtacaacggctcccaatctgatccaaaatcccgccggtctgtaaatattcatcatgtttcccctcgctatggcttcaaaatcactttaatgtcgccatcttcttttttgtcaaatatatcatatgcagcaggagcttccgcaagactcattttgtgtgtaatgatatccgtcggatcaatttcattttgttcaatcatttgatacagcatcggcatcagatgaataacgggtgcctggcccatttttaaagaaacgttgcgtgtaaaaaaatcaccgagcggaaagccgtccgcttcagaaatgtatgcgcccgtgagctgcacggttccaaacttcttaacggcttctgatgctataagaatcgggctgatcgttccgaactgattcggtttttgctctgctttttcttttgaaagcggcgtgccgtccattccgacacaatcaatcactacatccgcgccccctgacgtttgttcatgcagcagtttcccgatctcatcatgttctgaaaaattgaaggtctctgctccgtttatgcgtctcgcatgttcaaggcgatgcgggacttgatcaactgcgataacccgtttagctccttttttccacgcgaatttttgcgccattaagccgatcggacctgatcccaaaataacgactgtatctccttttttcactccgctgtgctgaacgctccaaaaggcggtcggcatgacatctgacagaagcagcacctgctcatcttcaagctcactgtctgccggaaccagaaaagaagagaaatcagcaaaaggaacacgtaaatattcagcctgcccgccgggataattaccgttaaactccgaaaaaccgaataaaccgccggcatctgtatgaggatttggatttgattcatcacactggctttccatctggtgcttgcagtaatgacattctccgcagccgatgttaaaaggaatcacgacacggtcgccttttttcagctttttgacttgactgcccgtttcttcaacgattcccatcggctcatgcccgacaatataacccggatcggcgggtattccgtttttatataaatgaaggtctgaaccgcatatcccggttgcggtgattcgaacgatgacatctctctcatcttgaatggcgggtgccgggacttctttcacttccatatgttcttttccttggtatgtcaatgctttcacacttggtcagctcctttttcatcactccttcccttttcacctgcttctaaacttggccggtatgttattcggcccgctgaatatcccattgaaaaggatcttcaagctgcgaccaatcagaatcgaactcagactgcgtgagcaggcactgatccaattcctttgtaatggcggcttcatctaaatctgttccgataaacaccaagttcgtatgacgatctccgaattggtcgtcccaatcttccagaatctccggttcctgctttttgatctgctcctgctcaagtttcggcattgccgccacccaataagaaacaggctcaatcgaaaccgccggacccgcctgagacatcagcagcgcaaggctgttgcgggttgcgcaccaaacaattccttttgcgcgcacaatgttgtcaggcattgattgatgcagccagctgtcaaaacgaacggtatgaaacggcagacgccgcgagtacacaaacgaagtgatgccgtactcttccgtttccggagtgtgcgcttcatgacctgccgtcagttcctttatccatcctgctgatgaactcgcttcctcaaactcaaataaaccggtattcaatatgcattcggcgggcacttctccgcgaacggaccggatcagtctggcacggggctgtaatgcgcgaagaaccgtttccagctgttcaagctctttttcgcccaccatgtcgcatttatttaaaatgagcacatcacaaaactcaatttggtcaattaataaatcggcaatctcccgttcatcctcttctcccgccgcttccttccggtcaagaaggctgtcaccggactggaaatcatgccagaagcggtttgcatccaccacggtcaccattgtgtccagcctgcagaatgttgtcagatcaatgcccatttcttcatctatataagaaaatgtctgggcaactggaatcggttcgctgatccctgttgattcaatgacaatataatcaaacctgccgtctttcgcgagtttctcaacttcgactaataaatcttcacgcagcgtgcagcagatacagccgttggataattctacaagtttctcatccgtccttgacaaaccgcctccctgcttcaccaagcccgcgtctatatttacttcgctcatgtcattgacgatgacggcaatttttaaaccgttgcggttttgtaaaatatgattcaaaacggtcgtctttccggcaccaagatagccgctcaatactgtaaccggaatttttttcatatcaatagccccctgataaaatagaatgattacgatttatatctcgcaactgccttattttcatcatgatgtacatagttttaaatcgcaatcgttactatttattttgatgtattctccgtttaaaatcaagtaaaagtcagacacatcacacgttgtttgtccccatccattggtctgacacgcaaaacgtcaacgatttaattggtgaagccttggatccggactgtaaaatgcccggttttaagatgtgtgcggtacgaatcatccctatctaattttcataaaatttttagattttttcgtattttttgttacatttcataacatgcatcttaaatatttgtttttgctgtgctacgctgaaaaaaacaaagataaggagcggatcatctgatgggaaaaaaacagctagtccttgttggaaatggaatggccggggtaagagcgattgaagaaatactgcgtgtttcaaaagacgaatttgagattacaatattcggggccgaacctcatcccaactataaccgaatccttctgtcaaaagtgctgcaaggcgataccgacattcaagacattacgttaaacgattggaactggtacaaagaaaacaacattcagctgtataccggtgaaacagtcatcaaagtcgacacggaaaaccaaaccgtcatcaccgatgcagacagaatccagccttacgatgaactcatcctggcgacaggctctgtcccttttatccttccgattccgggcgcagacaaacaaggcgtcacggcattccgagacataaaagataccgacacgatgctcgccgcgtcaaaacaatataaaaaagcagccgtcatcggcggaggactgctgggtttggaagccgcgcgcggactgctgaatctcggcatggacgtgtctgtcatccacctcgccccattcctgatggagcgccagcttgacgcagcggcgggacgcctgctgcaaaacgagttagaaaaacaaggcatgacatttttccttgaaaaacaaaccgaagaaattctcggtactgaccgtgtcgaaggcgtacgctttaaagacggcacaagcatcgaagctgatctggtcgtcatggcggtcggcatccgcccgaatacacagcttggcacagaaagcggcatcccggtaaaccgcggaatcattgtcaacgattatatgcagactgaaattccgcacatttacgcggtcggtgaatgtgccgagcaccgcggaatcgcgtacggtcttgtggcgccgctctatgaacaggcaaaagtgctggccaaacatatttgcggcattgaaacaaaaccgtacgaaggctccgttctctccactcaattaaaggtatcaggcgtcgaggtcttctctgccggcgactttgatgaatcagaggacaaaaaggcaataaaagtgttcgatgaacaggacggcatttataaaaaaatcgtcctgaggggcaatcaaattgtcggcgctgttttgttcggagacagcagcgaaggcaaccgcctgttttctatgattcaaaaagaagcagatatctctgaaacctccaaaatatcaatcttacagcctcttgatcaggaagcaggcgtaagcatgaccgcggcgatgagcgacgatgaaatcatctgcggctgcaacggcgtttcaaaaggtgccattattcaagccattcaggaaaaaggctgcacatcaacggacgaaatcaaagcatgcaccggggcatcccgttcctgcggaggctgtaaaccgctcgtagaagacattcttcaatatacactgggctcagaatttgactcatccgcgcaaaaagaagcgatttgcggctgcacctcactgtcgagagatgaagtcgtagaagaaatcaaagccaaagggctctcacatacgagagaaatcatgaacgtgctcggctggaaaacgccggaaggctgctccaaatgccggcctgccctcaactactacttaggcatgattaatccggctacatacgaggatgacagaacatcccgttttgtgaacgaacggatgcacgccaatattcaaaaagacggaacatactcagtcgttccccggatgtacgggggcgtaaccaactctcaagatctccgcaagatcgccgatgtcgtcgacaaatatgagatcccgctcgttaaaatgaccggcggccagcgaattgatctcatcggcgttaaaaaagaagatctgccgaaagtatgggccgagcttgatatgccgtcaggctacgcgtacggaaaaacactccgcacggtaaaaacgtgcgtaggcgaacaattctgccgcttcggcacacaagactccatggcactgggtattgcgcttgagaaaaaattcgaagggctcaatacgcctcataaggttaaaatggccgtgtccgcctgcccgcggaactgtgcggaatcaggcattaaggaccttggcgttgtcggcatcgacggaggctgggagctttatgtcggcggaaacggcggaacccatttgcgcgccggtgatttgctgatgaaagtaaaaacgaatgaagaagtcttagaatacgcgggtgcttaccttcagtactacagagaaacggcaaactatctggagcggacatccgcatggcttgagcgcgtcggtttatctcatgtccaatccgtattaaacgatccggaaaaacggcaggagctcaacgacagaatgaatgagacactctctgtccacaaagatccgtggcaatacttccttaaagataaaaaagcttctaaagatctattcgaaaatgtcgtcacgacttcataaaacagtaagggggaacggacatggttaataaagatatgacaaaggtttgcataggcaatgtaaacgaattacccgaggagttaggaaaaaccgtatatatagaagataaagagcttgccgtatttaagctttctgacgggagcgtccgcgccgtcgaaaaccgctgtccccataaagagggcgtcctggctgaaggcatcgtcagcggagaatacgtcttctgcccgatgcatgactggaaaatttccttagaagacggaaaagtccaagagccggatcatggctgtgtcaaaacatacgaaacactgatcgaaggagagaatgtatacctcctgtattgatcaaagaccggatcacttttccaagtggtccttcattttttaaattgctgaagggatgacgccatcatgaaaaacggaatcgtatactttgtcggtgccggaccaggagacccggggctgatcaccgtaaaaggaaaacaggctctggagaaagcggatatcattttgtatgaccggctcgcaaacccaaagtttctagaatacgcctcaccggactgccggttcatttattgcggaaagctgcccgaccgccattttatgaaacagtctgagataaatgccctgctgatagaaaaagcggcggagggctacaccgtcgtccgcttgaaaggcggagacccaagtgtgttcggcagggtcggcgaagaggcagaggcgcttcatcagcacggcatccgctacgaaatggtgcccggcatcacctcgggaattgcagcgccgctgtatgcgggagtccccgtcacccatcgtgatttcgcttcgtccttcgcgatgatcaccgctcatgatacatcattgcacggcaggccgaatctcgactgggaagggcttgcccgaagcgttcaaacgcttgtgttttacatgggcgttaaaaatctgtcatttatatgcaggaagcttatggagtacggaaaatccccttccgttcccgtactcgtcattcaatgggggacgtggggacggcagcggagcgttaaaggaacgcttcaggatatccatgaaaaagttcaaagccaaaacatcaccaaccctgccattatcgtcatcggtgatattgtcaattttcaaacacacagctggtttgaaagcaaaccgttcatcggacggcatatcatggtggtcactcatggggatgatgaacatacattgacagacaagctgcgcgagtatggcgccgatgttattgaatggccgaagcggatcgttaaaaaaatgcccgcaaacgaaaacatcctgaaacagatcagcacctttgaacaactatttttcacatcacgccttgcggtatgcgaattctttgacacactggctttcaagcagatcgacatccgccgggtgaccgcaagcctgaatgcagcgactgaagccgcaaagacggaactgacaaaacggggctttctcctatccgaatggcaaaatgattctccgcattctctcattgtagggagccgtcaagcagcagaaaacttgccagactcaaaatcatgcctgttttatatcacccatgaacatatcgcggatgagcgattcacttccatgatcgaacgcacgatcagtgagtcacctctgcaaatgattatctgtacgggcaaagaatccgctcagcatttgatcagcgccggaaaacaaatcggcatatcaccgaacccgagaggaaaccgccctcccgtcatctgcatgggcgaagacctccccgccggctgcgggtttaccgccgtgaaaaatcaggaacagttatttgcgtttatacgaaatgaaatgaaagacatgctcgttcacagctgatacgccggaatgcttttctgacccccggacccagcatcggggggcagcccttttttattgtgtcaccaattttttatgatgagtcgaatacatcgccatctgatccgcatgcgggtccaaataggctttggcgctgttcactgcggtcggcccctccgtgaaaccgccggcaatcagtctgagcttgctttcataatgggcggcgtcaccggcgacaaacacgcccggaagattcgtgcgcatatgcctgtcagctttaatcctgccttcttctatctcaagcccccagtccttcatcggaccgagatcaattttaaacccgtggttgataatgagctcatcaagcttgatgacttcagaaagtccggactcagtttggcaaacggtgacgctctcgatccgttccccggtgccgttgagatgcttcagacgatacggcgcaagcacccgcacggaagaccgcttcattttcgccacgctgctttccaaaccgccaaactcctcacggcggtgcaagacggtaacagacgccgcaatcggttccagctcattcgcccagtcaaccgcggtatctccccctccggaaatcacgacatgcttatctcgaaacgcatcaagcttctccaccttataatgaaggttctttcctgaataacggctcgcatccgcgctgtcaagttcattgacctcaagcgtccccatgccgacggccaaaatcaccgtgcgcgtatagtgcttttccccttcggaactttcgagcacaatggttccgtcttccagccgttcaaatccggccacccgctgattcaacacgatatccggctcaaatgtcgccgcctgctccttcagctgcttaatcagctgttccccggcaatcccgggtattccgccgatatcacggatgattttttcaggaaaaaacatagacacctttcccccgagccgcggcaaaaactcgatcactttcgttttcagctcccgcatcccgcaataaaaagccgcaaacaggccgatcgggcctccgcctataatcgtgacgtcgtacacctcatgattttccgccatcgttctgcctcccgtttatatctatacttcatacttttttaattgagaatcaatatcaatgaaagtataacatatattgaggagcagtgtttattcatttctcatcttgcgggaaaggagtgattcagaagtgaggttctgagattgataagcgggaaggtattaaaactgaaaccagtacggcgactggtttcttttttatctctttttcatcagcatgatatcgagatacagctggcaccttgtcctgaagtcgtttaaattaattgatgtcatgtcaagaatctgtttgatgcggtagttcaatgtgttttgatgaataaaaagctgttctgcggctggttttgttttgcagttattgaggagatagatttctaacgttttcagcagttcggtgctgctttctctgtctttggcttttaataacgctaaatcatcgtttacatattccagtgaggcgtttttttcttcgatgctttcaagatagcggtaaatcccgagcttactgtattcgtacgggatattttcctggtttccggtaatttcggcggcctttataacttcaagggcttctatataacttttgccgagcttcaggatgctgctgtattcattgccgattccgatatagatgggagtggggatcttctgaaagtgaaaatgagtcagcagtttgtggatgaattcagatgctgccgaagtgccggagcttttttgcgagaagcttgcgacgacgatgacaatattggaatcaatggttaagacgtggctgactttatcccgcaaattcaagtacgatttgatattttcctttacatcttcgactgcctccccatccccatttgcggcgtgcaggacgactaccgaaaaaaccgacggcagcacggcgttcatcttttccgcttcccgcctgaactccttttcagaggagaattgctgaaagatcgcccgtttcaccaggtcttccgctctctcttctttttcctgtttcagccggttcgttttgtagatgatttttccgacatggaatgaagtttcatataaaaaatcgagctcctcgtccgtcaagtttcggtcgagctcctgaatccagatgtagcccatcacttcccctttatgttttgcgcttacaaccactctctgattcaatccgatactgtctattttttcgacacggaacggttcaggaacggttttcagcttttcgatcaccccgtccttcagaaacctttcaaaaatctgcacggggcatttttttgagaatatcgtctgctggttggcggagtcgaagtgattaatgtaataagaattataggcaagcaaaaagaaatccgcgctttccagaataacgggcttctgcaattcataactgatgaaatcaattaatttatcaatgtccgtaaatgaaaaaactctctctaaaagctcttccatacctatttctcctatgctctttttatctttatcatactctgaggggtgactttttgtatagaaaaaaattcatatactcccaaaacggaatgatccgaaagcctgtatcgtgaaaagaggaaaaagggcggtcccttcttcctctcgttccttgcttttattgagaaagtgtatcacggtagtcatgaaactgatctgtgacatcttttgacggagcctgtgtcaataagctgacaacaaatacagcggcaaggcttacagcaaagcccggaatgatttcgtacaaaaagtctgaaagactggcattcgcccaaatgattacggtaatcgctcccgcaatcatgccggcgagtgccccccatttcgtcatccgtttccaaaataaactgagcagtacgaccggcccgaatgaagcgccgaatcccgcccatgcatagctgacaagaccaagtatcgtgttgtttttctcccaggcgagcaccaaagcgatgattgacaccgcaagcactgccattctccccagaaatacgagttccttatcagaagctgaacgcctgaacatggacttatacaaatcctctactaaagaactggacgtaacgagcagctgagacgaaatcgtactcataatggccgctaaaatcgcagaaatgagaaatcccgtaataatcgggtggaacagaatgttgccgagctgaataaaaatggtttccggatcagccagcttcaacccgcgctggtggtaatacgcgattcccgcaagacccgtaaacagcgcgccgagtgcagacaaaatcatccatcccattccgatccgtctggcgcgtttgatctctttcacagatgtgatcgccataaaacgcacaataatatgcggctgcccgaaatagccgagcccccacgcaaataaagaaataatgccgaggacggtcgtccctttgaacatattaaacagttccgggttgacggaacggatatcggcaacggtttcccccgggccgcccgtatggaaaatcgtcacaatcggcacaagaataagcgccgcaaacataatgatcccttgaacaaagtccgtccagcttaccgccaaaaagcccccgaacaaggtgtaggcgacaacgacgcctgtcacgacccacagtcccgtgtggtaattcaaccctaaaatgctgttgaataagacacctccggacaccatgccggatgatacgtaaaaagtgaaaaagacgagaatgacgagacccgaaaacagtctgagaagcttcgtatgatcaccgaaacggttttcaaggaaacccggaatggtgatggaattccccgctttttcggtatacgttctcagtctcggcgcgacgaaaagccagttcgcccacgccccgagcacaagtccgatcacaatccaagcgccgcttaatcccgttgagaacatggcgcccggaagccccatcaagagccatccgctcatatccgccgcccccgcgctgagcgctgtgacggcagggcctaaagaacgccccccgagcatgtaatccgtcagatttgacgtccgtctgtaggcaaaataaccgataaacagcatgcccgccatataaatacaaatggaaataatcaactgaatgtttgctatggcatttcctcctccgctttatatgtttatggtgaaatggacaccccccgcgaggaggatgcccattcagtccctcttaaaacatttcactgattgttttcgcctgcatgtgaagggccaaataatccgggccgcccgcttttgaatcagtgccggacattttgaagcctccgaacggatggtagccgacaatcgctcccgtacaattgcggttgaagtacaggttgccgacatggaattcctgtttcgcccgttcaatatgtttgcggttatttgtaatgaccgcgcctgtcaaaccgtattcagtattgttggccacttccagtgcttcatcaaagtttgatactttagaaaacgccacgaccggcccgaaaatttcttcctgcatgagtctggctttcggatcaaggtcagcgaagatcgtcggcttgataaagtagccttttgaatcatctccggtgccgccgcttactaaacggccttcttcttttccgatttcaatgtagctcatgatcttgtcgtaagaaccttggtcgatgacaggtcccatatacacgtcagcgctgtcagggcttgccgtcacttttgattcagtgatttcgatgacgcgctctaatacttgatcatacactttttcatggacaactgcacgtgaacctgcagaacatttttgtccagcgaagccgaatgctgatgtaaagatggattgagccgccaattcaatgtccgcgtcctcatcgacaacaaccgtatctttaccgcccatttcagcgataacacgctttaagtgctgctggcccggctgcactttcgccgcgcgttcgaaaattctcgtaccgacttcacgtgatcccgtaaacgtaatgatgcttgttttcgggtgatcgacgagatagtctcccacttccgctccgcttcccggcacaaagttgacaacgcccttcggaagacctgattcctcaagcacttctacgaacttcgccgcgatgaccggtgtcgcgcttgccggtttaagaacgaccgtgttgcccgttacgatcggtgccaccgtcgttcccgccataatcgcaaagaggaagttccatggcggaatgacgaccgttacgccggtcggtgtgtagacatattggttcttctcgccttcgcggctgttgaccggcttgccttttgccaattcaaccatctggcgcgcgtagtattccataaagtcgatggcttccgccgtatccgcatcagcttcattccaaggctttccggcttccttgacgagcagggcggagaattcgtgctttctgcggcggactttggcagccgcgcggaacaaaacggcagctctttcttcaggggatgtgtatctccactcttcgaacgctttcgcagccgcttcaatcgcctgctcagcgtgctcctgggacgcctttgacacttttccgacgacttcttctttgtctgcagggttaatggatacgattttcgcttccgtctctaccttttcaccgttgatgacgagcggataatcttttcccagatactcatttaccgtcgcaagcgctttcttaaattcttcaacgttcgattgatcttggaaattcgtgaatggttcgtgtttataaggtgtagtcattgtcatctctcccttttttacttcttagtcattcctttaaaggcgaatgcgatgtttgaggggcgctcggcgagccgtctcatgaaatagccgtaccagtcatccccgtaaggcaggtagactctcatacggtatccttcttccaccaggctgagctgggtttgcgagcgcatgccgtacagcatctgaaactcaaaacggtcgtttggaatgccgtgctcttcggcaagctgttttgtaaactcgatcattttgtcatcatgcgtggcaactgccgtataatgtccttttaaaagctgtttgcggatgagtcttttataattttcatcgacgtcgcttttttcaggataggccaccttttccgattctttataggcccctttgacaagccgcagaaacggattcagcgggctgaggtcatcaagatccttctccgttctgtacagataagcctgcaccacggtgcttacatattcataccggctccggaagtctttaaagatatccagcgttttctggcatctcgtttcatcttccatgtcaatcgtcaccatgactttatgtttttcagccgtctggaggattttcgtcatattttcatagacgagatcaagatctatatcaagacctaaagacgtcatttttaatgacacttgggaattcagctgttcatcagcaattaaggcgatggtctgcatgcactcctcggtgcgttctttcgcaacgtcaccgttgttgacaaattcccccaaatgatcgacagtaactgacagcccctggctgttcaaatgtcggattgtcgggatagaactgcggaaatccattcctccgatgattttgccggctgccacacggcttccccagcttcgcgccatcttattgagaaagctgctcttggataaaaataagaaaaaatctcttgtaatcacttccaaccttaacaccccgcaatctaagaagtatttgtatgagtctattgtaaatggacaaaacatcctctcacaatattctaaaaatacaaagattctgataaatttttgtggttttaccacaatcagcttcttagatagcaggcggattatgccgaaaaaaggcggacggaaatgacggcaatcgtcaatttccgcctttttccccccacgcctcttcgacggtctgaatcaatagctgattcagttcctccgttatgtcaggtttcggtgttttgatcgttttgacatagtgcccgatgcgttctatttcttcttctataaacgcgtgaatgatcatatttctcggttccggagccagctcctgaccgctttttttccttgtaagcagtgtattgatttcagaaatgagcgcttcatccgtcaataaggcatcggccagtacgggaaatgacatcggcggtacggagccgaacgtttcaatccatctgcaggcaaggagaggacgcaaaacataaaaatactttttaatcttcacttcactgccctgcaattccgttttttcattccgttttgccatattgagataatgataaatgccggcttcaggcgaaaaggcgcggattttcagttttcgaagcttttcagccgctgagaaagcttcataatagatcatctcagaagagagccattccaaaagaggcggatttgattttttaaaaagccgcagcgcttttctcagttcccagccgctgatgtcaagcatgtcatgaatcggctcttctatgacatccctatgcggttcgatcgaaaagtaccattcttttttcggcacatagagaaaccgcacatcgtagtcgctgtcgcttgacggaaatccccatgcgcggctccctgattctacggcgtaaagcaccttgacgccgtgctgtgcttcaattcgttttaattcttcgatgatcctttgttccatctgtatccgtccttttccgtgatcattcctgaaaaaagcccaagtacttgggcttttcgctgtcgtcagcctttcagatgcgctttcagaaaggccagcttttccttatggaaagaaggtatgtattcatgtccgaaataccggtaaaccttcaattctttttccgtttccagatgattgtaagcggcaaacaccgtcgacggcggagtcacgcggtcaatcagcccgatagacatgagcaccggaacttttacgcggtccgccagattcatgatatcaaaataggccagtgtattcatcgcggccttctccgtctcagggctgccgttctttctgaaaaaagagttaatctcaagatacggctcatcaagagcgacatcaatggcccgctcaaaattgcttaaataaggataatcggccgcaaccgctctcggaatgtcagatagtgccgccgcggcgattgaaagtccgcctccctggctccccccgatgacggcgattctcgtctcatccacttcatcaaagccgctgatgacttccaaagcccggacggcgtctaagtacacgccgcggtaataatatgtatctttatctaaaatccctttcgtcatccagccgggaacgtgtccgtgcggtgagacgcttgtatctgtgctgctgtgctggccgcggacaagcatgccgaacgcggcatatccgtgaagcgcccaatttacgatgtcatgtatatctccgtcataactcgcgttgtagccgtgatatttcacgatggccggatgcggtccttgccggtcgggaacggcgtaccatccctcaatttccgccttgccgaagcttcggtatgtcagccggaatactttcacgccgtcagccgggtagctttcagccgtcaattcaggctttgcctcttcctttgcaagctcatgtaatgatgatgcccaaaaatccgaaaagtcatgaggagcggttttatttggtttataggtttgcagttggtcgagcggcaagtcgtataattgcatatccgattattctcctttgttttataagatttaattttctgactctatcttaacacgattttacactcattttctaaacattttaataaacgtttgtttaaaagaaaacaaaaaagccgtacgctcacagcgtcacggctctttttacatcggctgatacagatcccagccgatttttaacgtttctacgatataatcggcgatttcttctggttccagattatccgtcgccacttttgaattatgtttatcatagatgctttggcgctcgttaaagagctgctgcatttcatccatggaacggttatgcagaacgggacggctttcaatcagcaggtcagcccgctgcttccaattctcccatgataaatcaagatggagcacgagacagttttcgaggcagcactgtctgattgcctcttgtttaaacgaaccgcccccaagcgacacgatcttgaatttcgtattgcggcagatatctaatatatagtccttttcagtttgacggaaaaaggcttcaccttttttctcaaacatttcagggatggacatattgaaatctttctcaatctgcaaatcaatatcaatgaagtctctgtataatttcttagcgaccagctggccgattgttgtctttccgacacccatgaatccgatcagtacgatgtttctttctcttacgggaatggcacgttttgcgttcatcttcggcgaaatcctcctaagaaatgaaaaagttatgtttattatatgataacccaatattgaaatatagagataatgcaataaaagaaaacccatcctttataagaagagatgagtttttctttctatcggagcgtaatgcgttccacctttccgacaatgaaaatataagaaaatgccccgataaatgcgacagcgccgacaaacagaatcgctccgttatatgaaccggtcgcagaaacgataaacccgatgataagcggggtgataatgccggccatattggcgaaaaagttaaacacgcctcctgccaatccgattgtttcgcttggcgccacctcactcagcatcgtccaggatatattggacatgccctgcgcaaaagaagcaatggataagatcgtcaaaaccgcaggagcagaatccgtaacattcgcgagcacgatggagcctgtcagcagaagaccgaggatgacgggggttttccgggcaacgttcaccgacacgccccgtttcatcattccgtcagaccaatatccgccgaacaatacgccgaaaaaggcggcgatatacgggattgatgcggcgaagccgacttttaagaatgccatgtgctttgcctccgccagataagtcggaaaccatgtcaaaaagaagaacagcgtggaggctacggcgaattggccgatatacaagccgacaagcttgcggtatttaagaagctggacgaaatcccgccacgtgatcctgccggctgattcagacacctctgtcagtccgccgccttctctaatataatcaagctcttcccggttcactttccggtaccgattcggctcgtgatacattttgaaccagaaaacggagaaaacaagcccgagcacccctgaggaaataaagacggcgcgccagtcaaatgccgttaacacccagaataaaaccggtgtggcgaacgccagtcccacatattcccccgccgtataaacacccgtggcaaaggcgcgttcccgccttggaaaccatgtcgtgacaatccgattgtttgccggaaacgcaggcgattcagccagcccgataatcaggcggcagccgaataaaaatccgaaactggctgcaaaagcctgcactccggtgaaaacagaccagatcattaaagaaacgccgtacgtccgttttgacccgaatttgtccaaaatgagcccgccgggaatctgcatacccgtataggtccagctgaatgcggaaaagacgacgcccaaaagcgcggggcttatgttcagcgatgtctgaatggacggggcggcgatggatacactggcacggtctatataattaatcgcagtgataaaaaacaaaagaaacagtatcacataacgagcgcgagtcggtttattgcggacgggactgaagtccgtcagctccgtttcatttttcaatggcttctccccccttactcgaatgaaattaattgtacaacacttcggtcaattatttaatactttgacgcaaaaaagcgctaaacaatttgtgcgccgcactgacactccgcttataaaagtgtctgcccttttcacctgtttatccgtatctcacccggggaaaagtacacatatgatagacagttacgggaggattaccgatgaaactgagtttttgcacgacaggatttaaaaaaaagcatattttcgacatcatttctttcgcgaaggagcactcctttgacggaatcgaactgtggtacggacacgctaaacaatatatagaggaaatcggcccgctcgacaggcttgatcagcagcttcaggaggaaggcctcggggtgcctgccgtcagtttgtacactgacttcgccgctcaggatgaaaggcaggcgttaaaggatgttcaaggggcattaagcgcggcacgacagctgcacagccccttgatcagagtctttgccggcaatcttccttcgcatcggacgtcaccggaaaagtggcaacgtgcggttgatcaatttcagcaggcggcacggctcgcagatgactatgaagtcgatatcgggcttgagattcattacgatacgtacgcggatacaccggaggcggcactggcatttttggaggatgtcggacatccgcgggtccgcaccatttttgacggctccaacctacacgtcaatcacgttgaccaaatgtccgctttagaaaagctgtatcataccgtcagccatattcatctgaaaaactatcactggaattttgacaactggtatctcagcaagccaactccgattttccaaggagatctcgatcaaaaagcatttttaaaagagctgatgaacagacaatatgacggttttgtttctcttgagtattttggagaacatgcctttacgcatataaaggaatcgctccgggaatatacgtctgttttttcccgctgactcttcgatcgaagggtcttttttttgtatcatatagaaaaagggggatatcatgatgatcatttggataaatggggctttcggttccggaaaaacacaaacagcgtttgaactgcacagaagactgaaaccgtcttacgtatatgatcctgaaaagatggggtttgcgatgcgttcgatgataccgccggatatcgctgaagatgactttcaaagctaccctctgtggcgggaattcaattacagcatgctttcctatttgtcagatacatatcagggcatcatcattgtgcccatgaccattacgaacgatcaatacttccatgacattatcagcaggctgagacaggatggccggaccattcaccactttaccctgctggcttcaaaggaaacattgctgaaacgcctgcgcaccagagcggaaggaaaaaactcctgggccgcaaaacaaatcgaccgctgtatcaacagcctgtctgatagcctcttcgcagaacatctccatacagaccaaatgtctattcagcaggccgcagaaacgatcgctgcccaagcaaatctgcctcttgagcctgattcgagaggcagccttcgaagatttaccgacaaattaatggtgaagctgaatcatatccgtatcaaataaaaaagcgttttgaaaacatgtccctgacccatgcaaatggatcaataaataaaaagtccctccgaagggatgtttttttcaatttaagaaaaaaattttagaaataaaggaggaattatatggataatcgtctaattattaacactgtaatacatttcatttgaaaagggagtgttcgaaatgaaattcaaaaaagtgttaaccggttctgcgctgtctcttgccttactgatgtctgccgctcctgcctttgccgcatcaccaacagcatccccatccgtggaaaatagcccaatctcaacgaaagcagatgccggcattaatgccatcaagcccgttccaagccctaacggtattttcgctgcttctttcgaactgaatggtacaacatggatttttaaatacaaatactatgacagcagcaaagggtattgggtagggatttatgaaagtgtagataaataaaaatgaaataaacaaaaaacctccctttcaaaagggaggtttttttcattctatttccaccaatcatcaaacatcgatgccggcacctggcgcttgtgctccgtactgaggtagcgtttttccagcgcttcaatcacttcggaagaaacatccttgccttctaaataatcatcaatgtcattgtatgtgatgccgagctcggtctcatccgtctgctgcggtttttcatcgagcagatcggccgtcggtaatttcaaatacaggcgttccggcgcgccgagttcttctaataaacgtctgccctggcgtttcgttaatccggtcagcggcagcagatcagctccgccgtcaccgtatttcgtgaagaaaccggtcaccgcctcggccgcatggtcggttccgatgacaagcagcccctcttgtccgccgatggcatattgagcgatcattctcattctggcttttacatttcctttgttaaagtcagacagctgatcgcccgtgtcttttttatactgatcagcgaacgcgctgacagcggacttaatatcaaatgtccatgatttatcaggtttaatgaatttgagcgccaattgggcgtcatcctcatcttgctgtgtgccgtgcggaaggcggacggcgataaattcagcgtttccgccttcttctctgatgctttcagccgccaattgggcgaggcgtcccgcaagcgtggaatcctgccccccgctgatgccgagaacaaagcctttggcacctgtttttttcaaatattgtttcagaaagttcactctgtcctcaatttcttgtttcggatcaattgagggttttacatgaagatcattcataatttgtttctggatgctcatcccaatcactcctcctgcattgtttctttatgattcatttcccgttcatactgaaaatgaatcatgccactatgtacgactctttgttaaatatagcacaggtgcagtttttaagtgaaccaaatacaccgggatcagctgatttccacccgcagcgccgtgatgctgtccccgttgcatttccctttttcgatcggacaggatgaaaacgcgacgacgagatccatttccgcacggagccgtacataatcacccgcgtcagaaagaggggtttcgactgataagttccccttctcatcgagcaccgtgttcataaagatggcaaatgggtaatgcatatgcggccgcggcaccccgaacggttcaagcgccccgctcatattgtcatagcacgtatcctggagctcgtccttatgctttccgtataaaagcctgttcatatccggacggcaggcgggaagcagcaagtcgtgcttgccgactgtatcctcaatcagcgtcagcatcggcttgtataaatttgaataaatatgatcacctgtttttacatgaatggactggttggcatcgatcgtcgcgccctgatcaagatgttcataaaagtccttggcatgatacgccgtaaaatcagccacctgctgcccttccacatcgactacttttataatctgccctttgtgaaccttcaggccgagcccttttttcggcggtacgataaattgctgtgtcatcagactgctcctttttttcttctattatgaaccccggccgtttgtttcatgtaaagcaatttattggatgtatattccccttctgacggccgcaatctaagctttgataaaggggttgaacttcatgagtaaatcacaggaccagcctaaagggaatctcgcttggtggcagctctccttaatcggtgtcggctgcacaatcgggacgggcttttttctcgggtccagcatcgctattgtcaaaagcggatattccgcgctgatctcatttcttattgccgggcttggcacctattttgtctttgagcagctcgcgaagctctcggccaaacagcccgaaaaggggtctttttgcgcttatgcgagaaaggctttcggcacttgggccggtttcagcaacggatgggtgtactggtcgtccgagatgctgatcacgggaagccagctgacagcgatctcgctgtttacgaagcattggtttccgaatgtgccgctgtggattttcgcctccatctatgcggtgctcggtcttttgattatatttacggggctgtccgtttttcaaaaaacggaaaatgtgctcgctgttgtcaagacggcggcgattgttatgtttatcgtcatcgccatattggcgctgtgcggtatattttctcataaaccggatgtgcaggtgccgaacgaatcaaaggatttgttcccgcacggagcgatggggttatggacgggattgatttatgcgttttacgccttcggaggaattgaagtcttggggctgatgaccgtgcatttgaaaaagccggaggaagcctcaaaatcaggccggctgatgcttgccgttcttgcggtgatttacgtcatttctctcggcctggcgctgctgttagtgccgctgggcaaattcaccgaacaggacagcccgtttattacatcgctgaagggttttcatttagatatcattcttgatatttttaacgggatttttattattgcgggattttccacgctcgtcgcctcgctgtttgcggtgacgacattgctttgtacaatggctgatgacggagatgcgccgaaatgcttcagattaaaggaaaacaaaaaaatctgctggcccgcgctcggattgacgtttgccggactcatcgtctccatcatcctgtcattggtgctgccgaaaaacatatatgaacacatgacaaccgcggcgggcctcatgcttctttatacgtggctgttcattttgttctcgggcaagaaactgcttgaaacgacaaagatgggaaccgtacagattgttatcgcccttgtgctgattgtcgcggccgtctccgggacgctgtttgagaaatcgagccggcccggttttctggtcagcctttgttttctcgccgtcattgcgatcgtgacatggatcgtacaaaaaaagcagggacacagccctgccggatcatagcttatttcgtcggtttaaacagtctcttcaaataagaaaagggacactttgacacttgggtctcatcatcacggaggaaatattgcttccattctaaattgtcttttcctccgtaccaccccaatcggggatgaagaggggcttcatcatacgcctctaagcgttttctgatcagccggctcatgtttcgtccgaacgcggttgaatcatttaatccttcaaaaacccatctcggctgaaacgccagcataaaaaacgggaagcttctgctttgtctcgcttcatgcgcaggcgtcgcgcacagaataaaatacggctcgccgtcaaagcagaactcccatttataatgttcagggtcttccggtatgtcttccggccagtctttcgggtcgcagccgctcagccggtttaaaaaagaccagaacagctcttcatacgcctcaacggaataatgctcagctaaatcctcaggcgtatcaaaaatcacaagcagcgacgcgtattttccggtattccttgagatctttccgtactcggacagcagcatccccacttcctccggggttccctcttcgcggggatcacccgcaaaggatatccggagctgatctgtcaaaaatccctgacgtccgggaatgcacggaaacgtatccgctttatcgcctactttttctgatagaagctcaaaagcgattctctgccaatttggcagatccaataacttttcctcaaggcaactttttgtgtacagcccgcttgccatcggcccacctccagtatcgtcaggatacgttatgatggagacaggcgataggtgacagtccttctatttatgagatgagcatttgaatcccctgccagccgaaataaaatccgaaaacgatcaaagacacacccgccgctcccgtcagccagcgaagcgctgtttcatgaagaagatttctgaaagtgctcgcagcgaccgccatgcagaaatcccagatcaaaatgccgagaagaatgccggagctgtaaatcaaaagctgatttgcatcgaaggattcagcggttttggcgagaatgctcccgtatatgccgagccagaataaaatgctcagcggattggaaagagaaataaaaaaccccgcgccgaaagttttgtaaaaagccggttttccttttccgcttctgacattcatggcttcccttatattttttaacgtttcgactcccgtgtaggtcagcacgaaaaaaccgaagagccacaaaaacgtttttacaaaaggagcggtcaaaaattgagacagcccgaaatagatcaaaatcatatacagcccgtccgcggccatggcgccgagaccgaaaatccatgcatgccaaaagccgtttttgatgcctttgtcaatttgcgccgcattgaccgggccgacaggtgctgacaatgacagcccgagaacgatgtagcttaaaaagatgttcattggcttccccctcattcatgcaacttgtacaagttattcatgaatgggccgtgctatgatacattattttaatttctcaagctcgtcttccatcatgtccgtcgcttttcctaaaaaatcgaatatcagccgcagttcttcttctttatattgccggcaaaggctgatcgtggactgggataaggagctgaataattgcttcacattcgcttttccggctgtcagcggcacgatgatcacccgccgtttgtcttcggggtcttttttcctcatgacatatcccgctttttcgagccggtcaatgagcgccgttaccgaacctgtgctgaggccggtttttttcccgagctcgcctgcggtcatcgggcctgcttcatttaagatatcagctgatttcaaatcggtcggaaacagaccgagagattgagcggccgcctgatgaaacaggatcgtccttgtggccatcttccggaataactgtatggcggtttcctccgtctcgcttctggtatttcttgttgacaactgacaggcctccctataaaatcaatttatcttgacgatcaagataattttcggcaaatctaatatgatcatagcaaatttaatgatcaaaagtaagtatgggaggaaaaagcatggaacaaacagccgcgaaggacgcctcgacgaagtttgtcgtcatcggtcttttgctgggcattttaatgtcggctatggataatacaatcgttgccactgcgatgggaaatatcgtggcggacctcggaagtttcgataagttcgcgtgggtgacggcatcatacatggtagccgttatggccggtatgccgatttacggaaaactgtccgatatgtacggacgcaagcgtttctttttattcggtcttattcttttcttaatcggatctgcattatgcggaatcgctcaaacaatggatcagctcattatttaccgcgtcattcagggaatcggcggaggtgcgctgatgccgatcgccttcacgatcatttttgatttatttccgccggaaaaacgcggaaaaatgtcgggcatgttcggtgccgttttcggcctttccagcgttctcgggccgcttttaggcgcgctcattaccgactccatcagctggcactgggtgttttatatcaacgtgccgatcggtattttatcattgtttttcattcttcgttattataaagaatcccttgaacacaagaagcagaaaatcgactgggccggcgcgattacgctggtggtttccattgtcggtctgatgttcgctcttgagctcggcggaaaaacgtatgattggaactccgttcagatcatcggtctgttcgctgtgttcgccgtgttctttatcgccttttttatcgtggaaagaaaagcggaagaaccgattatctcattttggatgtttaaaaaccgtttatttgccacggcacagattctggcgttcctttacggagccacatttgtgattttagcggtatttatcccgattttcgttcaggctgtgtacggcagcaccgcgacgagcgcgggctttattttgacaccgatgatgatcggttctgttatcggaagtatgatcggcggaattttccagacgaaagtgcggttccgtaatttgatgctgatttccgtggtcgctttctttatcggaatgctgctgctttccaatatgactccggatacggcgcgtacgatgctgacggtattcatgctgatctcaggattcggcgtcggcttcaacttctcactgctgccggctgcgtccatgaacgatctggagccgcgttaccgcggaagcgccaactcaacaaactcgtttttgagatcattcggtatgacgctcggtgtgacgattttcgggaccatccagacgaatgtgtttaccaacaagctcacagattcattcagcggcatgaaaggagcgggcggcgcgatgcagaacatcggaaatccgcaggagattttccaggccggcacgcgcgcccatattccgccgcacattctggatcgcattattgacgccatgtcgcaaagcatcacatatgtattcacgcttgcgctggcgccgatcgtcattgcggccgttaccattttgtttatgggaaaagcgagagtaaaaacctctcaggaaatggcgaaaaaagcgaattaaaaaaagcagtacatggcgtttgtcatgtactgcttttttgtttactccgcgaaatgcggagcgagaatgtctttcagcacgtttgcgctatggttgaattgacgctgttctgtttcattcagctcaagttccgtcacaccggcgatgccgttccgattgacgacagccggaatgccgataaagacgtcgtttacaccgtattgcccgtccagatatgtgctgacggttaaaatactgttttcattacgcaaaatcgcttttgtgatgcgggcgaggctcatcgccactccgtaatatgtcgcgccttttttctcgataatatggtaggcggcgtttttcacatcgtccacgatctgatccagctcgtcctgtttgtaagctgcatttttctccagcaattgctgcaccggcactccgccgatattggcgtgactccatacaggaagctcggtatcgccgtgctcgccgataatgtgggcgtgtacgttttgcggagcggcgccgaaatattcactcagcatataacggaatcgcgcagaatccagtgtcgtgccgctgccgatgacgcgttctttcggcagaccgctgaatgtccatgtcgcataagtgagaatgtcgaccgggtttgtggcaacgaggaagatgccgtcaaatccgcttgccattacttcaccgacaatgcttttaaaaatggcgagatttttttcgaccagctcaagtctcgtttcgcccggtttttgattggctccggcacagatgcatacgatatcggcatccttgcaatcttcatatgttccgtaagacgttttcaccggatgaggtgcaaatgcctttccgtgatttaaatccatgacatcgcccatggctttttctctatttacatcaatgatcacaagctcatctgtgatcccttggttaattaacgcaaatgcataactgcttccaacaaaacctgctccgattaatgctactttgttcactcgttcgttcatcatgtatgctcatcctccagtgtttcgtggtgtctgtttttaacttgtgaagtatttcacatttatattgtgcaacacttcacaaacttttgcaagagaaaagtttgatttttggacaaaaaatatcgatgatggtttccagattgttgacaacatcctaaaacggaaccgttttaggatgttgtatcttttcagcgtgattgaagacgtgctgtccttttcccagaagcgagggtttgccggcacgctgatgtgatgatagccctatccattaatgcggaagataaccgtttaaaccggagttgttatacaaaccattctgcacataatcaaatccgggctggttctgcccgggcacttgggcgctgccattgttaaaaatcactttggcattggccgtatccgcattcgcaggcagcgtcagcgtgtaaattccatttgcattcttagtcattgctttccccggccacgatccggttaattctatggccctgcctccatcatgtttgtaaatataagcatttacctggccccaatgatccggattttgatagccaatgatgttggtttgggcctggtcttttttgacaaacgtgtattcttgagttctctctgcaccctcgccgttcgttccggttaacctgatgttgtatgtcgtgccgattggatctcctttcccgatcgttaatcggtctccatccttaaatgctgtctgctgcccattattgatttggtaaacggcttttgctgttttcgcatttgcacgcagggtgaccgtcagctgatcattgaaagaatggactgcccccgtttggtaattctcaagaaagacatgaggcgcatttccaatatcatcagaataaagaacagccgcggatctggcattgatcgtacctgtcagtttgccgttcgctacttgaaatgaaccggcgccggccctattatcatacctgccgtcaggcaatttcgttgaagtattgacggtgacagaagacgatcccgcattagccagcacaacgccttttgagccgcgctgattcataaatatttgattgttcccattcggattcgagagttcctcaggctgcccggccattacattgtgaaattgattgaccgcagtgatcgcctgatctttaaataaggcgctcccgcgatctcctatttgactttttccgggaaatcgcaccccatttcctccgccctcaggtctggaaaagaaaagaggcgtgcttcctgagcgggaaccaatcactgcccagcctaaacggatatcgtcatcactcatccatgtggactcttcctcatcattggcatacgtatcatgtgattccacccatgtgaccaacttgtccgcagacacgtcagatgcataatgggagatattcgacacactcagattacggttctttaaagcggatctgatggaatgcccatagttagaagccgtcacattcatataattcgcataagcagtatctctggacgcgctgtcttgcaggatttctccgtattggaactccgccgatgtatttgtgatattcggccaaaatcggctgccgtaattcccatcatccggaagctctatatgcttggcggcatcatagcggaacccgtccgctccgtcattcaatgctctttccaagaaacgtttcagataggtttgcacctcagtattctgtgtattccaatcatacagcccaagcaatgaattttgagtgacgtcccacctgtccgaccaatttttaatttgtgtgtttccatgggtccagtttggaatacgcttaatctcgtcagaaatcgcggcgtaatcgctggtggtatgattgataaccgcatcaacaatgacttttacgccatatttttccgcggctgcacacatgtccttaaattcttgttcagtgcctaagtaacggttgccgatttggtacgatgtcggctgatacagccagtaccagttcctcatgcttttatctccttggttcccttcctttacttggttaatcggagacgtctgaatggctgcatagcccgcatcacgaatctctttcatattttgtgttaacgtattgaacgaccaattccaggcatgaaggatggtcccgtttttgaccgatgacgcggccacctcattcgatttgtttgcagtttcagcgtttgcagccgccgggcctgacaaaaccaaatgaaacagcaataaaaatccggcgaataacggcagtaaagaggttttgaatcgtttttcaaacatttttgacactccttatttcatttttgaagactgactgcggagtcaaaaattcctcttactctttcttcagctcctttcaactgttgtgaagactggagaattctgttaacgcttacatttcaacttatcacactctctctatcaaagcaacgcggcagagtgaattcaaatctatattcctatcaattaaaaagacttcccgctttcaaacaaaaaaagaaaccacctgtcaagatgatttcttttttatttcttttatcgctcttctgtaagacagcttcacaatgacataccgaagcagaaacagaatgcctccgcagacgataaaaagaaagatcattttcagccaagcaaagaatgtatggggaaaccccctgtcgtacatcgtaagcgccgccaccgcaaaagtgactgctattgaatctatccgctgctgcttcacccgctttttcagttcttctttggtgtctattctcggcatgagcattcccgacgctcccgccctgatgcaataataaacaattataatgaagaaaaccgccaagctcccggcccattccctaaacggacagttcagaacaagtccgcgtacgatgatgtcaagcaaagacagtgtgcccacaagcattccgacttctgaccaaatcattcgttctttctctttcacactctcactctttccattcacgtttgaaagtctgttccgacgctgattcatgacttcctcccgtactattaagaatggcttacaactcccattatatcttgccgattcataatgataaaccgaaatatcattgacaaaaatgttaataagggccccaattgatcaggacgcctatgcagataaacacaaggccgatgacaaaccaaatcagcgccagcggaatcatgaagcgaagccactttacgtacggaatgccgctggcagccagtacggccatcagaacgccggaagtcggattgacacagtttacgacgccttccccaagcatgaccgcttcaaccgcgacctgtctcgtgatgcccatcagatcggcaagcggcgccaaaatcggaataaatacgaccgcctcccctgagcccgatgatatcagaaaatgaagcagggcgctggaaatatacattccgattgcgcctgccatcgggctgaaaccgtgcagcagtgacgcaagtccattgactaccgtatcaagcagctttccgtgttccagaataacggaaatgcttctcgccattccgacgatcagcgcgccgtaaacgagcccctgacagcctgtaataaacgtttttgcgatatcatttgccgccattcccgcaatcaggcctgacacgattgagataaaaatgaacacggcggccatctctgaatcagaccagtcaagagtaagcgcgccgtataaaaagccggcaagcgacaaagccgcgacagccagaatcaatttatggcggacggtaaacgggactggcttgtcctccggatctgaagcctgcgggattgaacctgctgccggaaaccaatcgttccccagcagactggcgtcctttgcttttctgagccttctcgtataccgataaatatataaaatagatgatagcagaaaacaaatgtagacggcaatccgcaggccgatgccggaaaacagcggcagctccgcgatgctttgtgataacccgagcggtgaaggtgataaaatcgtcgcgttaaacccggcataacagccgatataaatgacggccgctccggccacggcatcccatttcagcgaacgggcgacgatcaggccgatcggaataaaaccgatcacggaattaacgacgatgccggttgtgccgaggatcgaaaatagagatccgacaattgcaataaacagcagctgtttggtgcggaacgtactgatgacattactgatcaatccattgatggcgcccgttttctccaaaatcgcaatggtgccgcccgtaaacaggattaaaaaaataatcggcgcggaacttgtcatcccttcctgaatcgcggtaaaaaaagcgatcgggctgacaggagactggtctaaagaatgataacttcccgggacggcggacgtcacactgccctttgtcaccctgtcaaattcccccgcaggaacgatgtatgatgctatcgcgcatagtaaagcgacaatgaacagcagcacataagcatcaggcatcacaaacaatttcttctttttcaatacaggttcggccttcggcacagccataacatcaccatcccgctttgaatttataaactattcagaaaatacagatatgtgctatattatatacagaccgattgcctgttttcaatatcaaaaataaaaaacagacagcttttgaaggaggacttacggcatgaacagactcacagagcatgaaaagcaagtcattatggacatttttgaccacctgcacgccaatcccgaagtaagctggaaagaatatcaaacaactgaatatctgactgaaaaactgaaagaggccggctgccgaatccgtacgtttgatgattgcaccggtgttgtcggcgaaatcggagaaggctcgcccgttgtggctgtccgggcggatattgacgcgctgtggcaggaagtggacggtgtctttcaggcgaaccattcatgcggacatgattcacatatgacgatggcgctcggcacgatgatgcttttaaagagtcagccgaagcttccgaagggcaccatccgctttatttttcagccggctgaagaaaaaggcggcggagcgctgaaaatgattgaaaaaggcgtactggatgatgttgacttcttatacggcgtgcacgtgcgccccgtacaggaaacggcaaacggccgatgcgcaccgtccattctgcatggctcaagccggcatatagaaggcctgattatcggagaagaagcccacggcgcgagaccgcatctcgggcttaacagtatcgaaatcgccgctcttctcgtccaaaaactcagcttcattcatcttgatcccggcatcccgcattccgtgaagatgacaaagcttcaggcaggcggagaaagttccaatatcattccgggaaaagcatcgttcagccttgatctccgcgcacaaaccaatgccgccatggagaaattaaccgccgaaaccgaaagagcctgtgaggcggcggctgccgcattcggcgcaaaaatcgaactgcaaaaagaacacagcctcccggcagccgagcgaaacaaggaggcggaagccatcatgacatctgcgatcagcagcattctcggagaagaacatgtggatgaacctcttgtgacaaccggaggagaggattttcacttttacgggttaaaggtgccgaacttgaaaacgacgatgctcggcctaggatgcggtctggagcctggacttcaccatccccaaatgacatttgaccgaagcgccatctttactggcgctgagatattaacggccgccgtcctcaaatcgtttgaagcataaaaaaaagcagcccgttacagggctgcttttcttcattacttcttcagatcttcaattgaattgacgtttttcatgtactgaggaacgaccagacccatcttgacgcctgtcagactcgttcctacatcttcatatttgcctttatatttagacgcatatgccttatgggtattcggaagccaagcagacaatgacgcatccgcgctgcctgtcgcaatcgcagtccacatcggtcctgcctccacttgcgtcagcttcacgtcatagccgaggtcttgaaatacttttccgattacattcgtacttgcgatttcactgtcccatgccacataagccaggttgattttatcccctttgactttatgggcgccttttgtccattgagccacttggtctttatgttttttcacatattcagctgcggctttggccggcttttcgccttcctcaacggcaatcatgacttctcccatatcgtcctgcgtccatttgaactggctgagaactttggccgcgttaggctgttccttactgaagccggttcttgtaatcgtatgaatctgctcggcagttccgtacgtttttttcggatcatcaaggaacttcagcttgtatctggagaacatccagtgcggcgtccagcccgttacgatgatcggctttttccggtcatatgatttcttcaatgtcgccgtcatggcggcacttgacgccgtgatgacattccagtctttcaatccgtaatccttcacggcctcatccgtcagggccatgatccccgatcccggatcgataccgataatggttttgttcacctggtccgcagccgttgccttatcatcagtctgcgaaccgcaggcagccaaagaaagagccagcgcagcggtaacgccgacaccgatgattttcttaagcatcaggcattccccctgctcttcttcttcactttaatgttttgcgtgatacggtcgagtgtaatcgctacgataacgatcgcgatacccgcttccactccgacaccggttttcaactgtgtcacggcgctgtatacttcagaaccgaggcccggcgcaccgaccatggccgcgataacgaccattgacaaagcaagcatgatgctttggttaataccggcaagaattgtttttgtggcaagcggaagctgcaccttgaacagacgctgagacgtcgttgaaccgaatgcttccgtcgcttcaatcagatcagccggaacctgtttaataccgagaactgtcatgcggatcgtcggaggcatcgcgaaaataacagatgccacaacgcctggcacaaccccgatattaaagaagaaaattgcaggcagcaggtatacgaaagccggcatggtctgcattaaatccagaatcggtgtgacaatgcggcggactgtttctttctgagacgcccatatgccgatcggaaccccgataataatggaaatcaaaacagatgtgacgacaagcgccaacgtttgcagcatcggcgaccaataacccaaataatcaataacaaggaatccgattaacgtaaagagtgcaattcctctcgtactgatccaccaagcgagagctgcaaaaataacagtcaataaaatagacgggatgaaacccaaaccgctcacaatcgcgtttacgaaagcggccaaaccgtttgagattccgtcaaagaaacctccgaacgtcatggtaagccagtcaacaaaccggtcaacgatatctgctaacggaattctaggcaatctgtccatttacttcaccccctgaacagaagaatcctgagcttgttcagcagaatcttcaacatttatataatcgttatttcctgaaagcgcgccgattaatgcgccttttacgacaatgcctttcatgcggtccttatcgtccgtgacggcgatcggaatattcgcatcagacacgacatcgaaaatttccgtcaagtatgtgctttcatgcacagtcgtaaattcagtatttaaaatatcctgaagcgataagtcggattccaccgcttttttcgcatccgccgcgtgaatgacgccgagaagctgtttctgtttatcaacggcgtaaatagaagaaataccgagattcttcatgagctgcagcgctacacgaggccctttgtcaatccgcacggtttcagcgcgcttcatgatgtggcccgctgtcagaactttggataagtcaacgtcctcaacgaatttctcaacgtattcattggacgggctcatcagaatttcttcaggcgtcccgatctgaacgatgttaccgtctttcatcagcacgattctgtcgccgatgcgcaatgcttcatcaagatcatgcgtgatgaagatgatcgtcttgccgacagagtcatgaaggtctaaaagctcatcctgcatgtctttgcggatcagcggatcaagcgcactgaaagcttcatccatcagaagaatgtcaggatcattcgtcaatgcgcgggcaagtccgacacgctgctgcattcctccgctgagctgatctgggaattggtgttcaaagccttcaagaccgacaagtttaagcgaatcaagcgctttttgctcacgctcttttttgtcgacgccttggagttccaacccgtattccgtattttcaagaatcgttctgtgcggaaacagcgcaaatttttgaaagaccatgctgatttttttccggcgcacttcccggagctggtcttttgacatatttgttatcatgtcaccatcaatataaatattcccggcagtcggttcaataagccggtttaacagccgaactaaagttgatttaccgctccccgatagacccatgatgacaaatatctccccatcatatacatcaaagtttgcttgattgacaccaacggttgatccggtcgctttcaggatctcttttttgttttttccgctggacagcatctgaatggctttttttgtctgttttccgaaaaccttagatacattttcgacttttatcttaattggtttctcatccaaattcatattttccctccataataagcaatctttaataccgtaacacgtttgtaataagtcaaacaaacatcataatcccgtttattttgtatcattactttaaaaacatccctgtgtcttattttcctctggtatgcttctaaatactctctaatcctccttattgaggataaattataaaggaaatcgggcttttatcaggcttgagaacgtttccatcgaatgtgctgcaaactgatttcctatcctttttttacaaatacaagaatttttttgcgacattgtcccggaaaaagaagttttcgcctcctgaaaataagggattttaaggaaaaatataggtctgccaacagacagctcactaaaaaaagcaccccaaaagggtgctcattgcgcaagctctgtctgtttcgtttcttttccgagaataataatggtgatgacggcaatcaggatggccgcacaaaagacagcgaaaatagctgtaaacgaaacgttccgtgctgcaagcgatccgacgagaagcggaccgaaaatgccgccgattctgccgacggccgcggttgttccggaaccggtcgcgcggatcgccgcagggtactgctccggtgtataggcgtaaagcacgccccatgcgccgagattgaaaaaggacagcagcatgccggccgtgagcagcatggccaatgaatccgcggcaccgaagaaataagcgctgcccgccgttccgagcaaatagatgactaagatggtcttccgccccgctttttcgatcagccacgccgctgagaaatatccgggaagctgggcaagcgtcatcagaaggacgtattcgaagctctcaatcatgctgtagcctttcatcagcatcacgctcggcagccataaaaacatgccgtaataagaaaagacgacgcagaaccaaacgacagacagcagcaccgtcggccggatatacggtttcgtccagacacttcccgcctgcccgcgtatgctttttttctgcgtcaatgcctgatgcgccggtgattccggaaggcttttccgcaagtacagcgcataaaacgcggccagcgccgttaagagcagtgcggcctgccagccgaatgacggtatgacaaagtaggaaatcaccgccgcaagaagccagcccgctgcccaaaagctctcaagcagcacgatgatccgtccccgcttttcgggagcggacgcttctgacacgagcgtcgaggcgacaggcagttccccgccaagccccattccgatcagaaaacgcaatatgagaaaaaccgtcaatcccgttgcaaaagcggatatgccgcttccgacagaaaagaataacagcgtgatcataaacacttttttccggccgatcctgtcggccagcattccgaataaaaaggcgcccgctgccataccgatggaattgacgcttccgatccatttcatttgatcgggtgttaaattccaatcagtgtgaagcgcggcgataataaacgataaaattccgacatccatcgcatcaaacagccagcccattccggcaatcgccagaagttttcgcggagtgacggcaggttgtttgttcataagcagcacctcaaatcgaaaatgattaccgtataagtttacacctgtctttacacattgtcattatcttttttcgcaaaaaaacccgcttgccgtaagcaagcggggtgcagattaattctttaagactgcgtttttaatattatcctgaagctgttgaatccgtttcgctccgtcttctctgatacgtctgttctcttcctcgatctgtttcgtttcctgcataccgctgacaatcgtattccaagacgtttcaatcgtctcaatgtcaatgctcggacggcctgccatacgggcaatctccacgctttggtttgaaatattttcagcgttgcgcttcagcatttcattcgtgcggcggtccagctcgctcattgaatcagccacaagcttttgccgtttgactgtgacagcctgaatgatgccgtttttgaaaatcggaatcgtaatgacgaaagcggaattgatttttccgatgagcttcgtatttccgcgctgaaggaggcggatctgcggcgctgtctgcagcgccaccatccgcgccatatctaaatcatagacacgttcctcaagcgcctgaagcccgtcacgcagcgtatcaagctgcatttgcgcaagctggtttccgccggccgctttttcttcataagaaggaatgagcgcctgcatttcctcaagcttcatctgcccggcgacaacatatttttcaagctccatgtagtagttaatgttgttttcatacatctcttcaagcgtatggttcgtctttgccatttcatctttgtattttgaaatttcgacgtggattttttcaatttctccgcccagggtgcggtacttttgaaaaatcttttcaatcatgctgttgccgcgtttgaacattttagcgagaaatccttttggttcatcgaaatcatttttgtcgaaacggtccatgatttttccgagctgcgtcagcattgtgcctgaatccgtgacacttgttgttttcatcatatttaagatgcggtcggagaacttcgagatttcaactgccggttcttttccgtactcaagcagctccatttggtttttcacgtcaatctgctgcgaaatgcgctgcacctcagggtcttggcgcagctgcgccctgatgtcatctgctttttgttcagaaatctcttcatttttatcaagaacaagcggattttgattttctgtcatatttatttactctccctgcttttgcgtaatggttctaaacagctttcttacgagtgacggctccttatattcctgccgaaacaccatgtcctccagccaatggacatcaaattggctttcttcaatataatgctcaatgtcctgatggcccggcggattatacaagatgatatcgacgccgaatttatttaaaaacaaaagagcggcggcatcagaacgtgtgagttcgccattttgttccgtatgatataaaacgagtttcggaacggtttgggcgtaatcaaacgtctgaatcaattgcagcagcgaagcgggcagattcgtcgcctggcggaacaaatagattgcggcatcccttgactgctccccgggcaaagccttcagccctgggtttctgcacatgtcagaaatcacattggcgatggcgctctgcacacctgaaggcagatgcttgtactgccagatgttgcttcttttcagcctgtccgcgtcaatctctcctttttcatttaaaacctgactgtagtgatactggtagttggctttcagctcttccgtaaacggaaaactgcggatcatgtgtgtctcctgatagtccgcggcggtatggagtctgttccaatattctttcgtatctttggaaacccccatcactttcgcaaaaaggttcggaacggccacccgctccctgtccgctttaaattgcggccggataaacgcccgctccttcgcaatgagaaataactcatcatacgtcgtttttaaggtcacggactgcggggtgtgctccctgaactgccaaggcttatacatcatggattcctcatggttcagcacatgctcaatttctttcgttgaccggtaggccgtcgtggacgttctgtccggcttttctttcggaaaaggctcaagaccgcctgttgcggggagctttatcacaaagctgagctcctcatccggatcaatcaagctgaacggatcttccgcagccggatgaaacaataggacatcacagccgatcagcatgagataatagagaaaatagagctggcttttggtcgcgtctccataccacaccaccttcggcatctcacactctatatcggcttgttcgagccatggattcaggtggttcagcgaaaactttgacacatccaagagcacacgccggaaatcgggatgattcagcccgttttcatgccggtccgcaaaggtttccaaaagcgtcataaacgcggtcctcagccggcggtgcataagcggatcagcgtgtttggcaagcagcctgcccccatcgagaaacgcgacaaacctggaaaccgaaagccctttctctttttgattgaccgaatgaatgtgctgcagcgcctgaaacgtttccggcgcgatggtcttatccagcgtctcgctcaacacatggatgttttcatgagaagacagctcgaaaagcttactgtaatactccgtctcatcataaggagtgcccaaaatccggccggcaagccgggtaaacgccagcccgttttcccgctcgtaaccgggacgttccggcagcggccgcatcagaaacgtttcccagtcatcgttttccggctcggcctttcggatcaccaattcttcctgcttcatcattttcctcctttctcttcatgataatcggtacaaaaaaggaaggaaatgaactctccctccttttttgttttattcttctttagatgcagccgtctgctcctgaacctgcttttgtttgttgaaatagtggataataaacgtgaccacaaatgcagcgatgatgattccgaagaacaccacgtgcggcatttcataatcaaaagcgctcgccgccattttcacggcgataatcccgatcagcacgaaagccgtgttttcaagctcagggattttatcaattaacacaaggaatacttttgcgactgtacgcatcatgagaatgccgagcataccgccgatcaagagcacccacactttttccgataccgcaaacgcggctaaaatgctgtcaacagagaaggccagatccattaactcaactgaaacgacagtggcccagaaaattccgaacgtacggaccatccatgaatttttcttcatgccttccgtatcgtcatcaccttctccgatccagaaatgcttaatgacgagccaagccaggtacagcgcgccaagcactttgatccaccagaacttaatgagcagcatcccgattccgataaagataaagcggaaaatatatgccccgaacaatccgtatgttaatgctttcttccgctgtttttcaggcagatgccttaccataaccgcaagcactaacgcattgtcggccgacagcagcccttccagcagaaccaaggaaccgatcagcccccatgatacagggtcagtcagcacctcaccccacattttccaatcaaaaaaggaagcgtaggtcgacataatatgatgtagaaaatccaagttttttcctcctatttagtaaaacggtaatttcctgcttacacctgcaagccgtaattccggcaaagtgatgccagaccgccggaaaacccgctgccgatggcgttaaacttccattcagccccatggcggtaaagctcacaaacgacaaccgccgtttcaatcgagaagtcttcccctaaatcgaaacgaagcagttcattctggctgttttcatcgacgacgcgcacgaacgcgttcgaaacttgtccgaaattttggccgcgcgcttccgcatcatgaatcgtgacggtgatgccgatcttttcaatatttgcgggtatttttgagaaatcgacgataatttgttcatcgtctccctctccctcgcccgtccggttgtctcccgtatggatgacgccgccgctcgggtgttccaggttattgtagaaaacaaaatcaagatcattaacacagttgtcatgggcatcgacaagaaaagccgacgcgtcaaggtcaaagtcatgccctccggagtacttgttcgtatcccagcctaagccgatcaccgcttttgtaagaccggggttcgtttttgtcagatcaacacgctgtcctttcgccaattgaatagccatgtgccgtctctcccttctgtgcttgatatggttttagccgatttgcaggccgtaatctgtcgcaatacgggccagtccgccttgatagcctgagccgatcgcggaaaatttccattcgccgttatgtctgtaaagctcccctgcgataatggctgtttcaattgagaaatcttcagccagatcgtagcggatcagctcttcatttgtctcttcattgacaatgcgaacgaacgcgttggaaacttgtccgaagttttggccgcgcgcttccgcttcatgaatcgtgatgacgaatgaaattttgtcaatagcggcaggcaccgcgctcaggttgacccttacactttcgtcatcgccctcgccctggcctgtaaggttgtcgcctgaatgtgcgacagagccgtttccgccttcaagctgattatagaaaataaaatcatcgggcgacgcgcatcttcctgcttcatttaatagaaagacgctggaatctaaatcaaaatcatgtccgccatcgtatttgtttgtatcccagccaaggccgacaacgactttagaaagacccggatttgttttagtcaaatctactttttgtccttttgccaatgaaattgccatgtgtgcactctcctttttatcgtttaggcgtatcggttaacgatatcgccgatttttgtatcgtttgtgccttctcctactgcggcgaatttccactcgccgtcctcgcggtagatttcagccgcgatcaggctcgttctgcctgaatagttatctcttaaattgtaagtcaccagttcttcgcgattagcctgatcaacgacgcggatgaacgcgttttgaatcatgccgaagtcctgttttcgtctgacgcagtcgtaaatattgacgacaaacacaagtttattaatctgagcgggcactttcgacaaatcgatgagaatttgttcatcatcaccgtcgccttcacccgtcaggttgtcacccgtatgtacgacaccgccgcaccggcttttcagattgccgaaatagatgacgtttttgctgtctgtcattttatcattttcaagcatcagtacggaagcgtcacagtcgatattggcaccgcctccgccgaacagctttccgaaaaagccgccggatgatacagggtcccagccgagtccgaccagcagttttgacaggccggcttttccttttgttaaatcaatccgctgtcctttttgtaaagagatcgccatatgattcactcctattctgtaagggtgccgctaagcacgccgcaagtgcgcatttttactaaattccgggacaagaatcccggtgtttattaagttatacgtcttttattatatcaaagtttcataaaacataagaatttttggcgaaaaacggcgaaaaattacttcctatattctccttcgttccggagagaatagagaaaacaaagaaattgacggggactgaacatttttcctatccttgtatcaatacatgtcaggaaaggggcagacgagtgattgatttaagcatacttgatcaggcgcccgtatccaaaggaaacgggccgcacgagacgctccgccgttcagcggagctcgcccgcctcagcgaaggatggggctataagcggtactggtttgccgagcatcacggcacaagagggctcgcaagcgtttcgccggaaattatgatcgctcataccgccgcagccacaacgtccatccgtgtcggatcaggcggcgtgctgctgccgcagtacagcccctataaagtcgcggaaactttccgtcagcttgaggcgctgcatccgaaccggattgaccttggggtcggacgctcaccgggcggcacgacgaaaatccggctcgccctcacagacggggtaaagaaaagtatgaccgagttcaacaggcagcttcaggatttatcatcctttctgacagattcggttccctcggaccatgcttatgccggaataaaaacagcgcctttgattgaaacagccccgcagctttgggtgctgggcctcggggaaaacagcgccagacgcgccgctcttcaaggtgcgggctatgtcttcggccatttcattaatccggaacgcggggtaaaagcctttcagatctatcgggaccatttccgggcctcctcccatttttccgctccggcctcactctgtgccattttcgtcatatgcgcagctacggatgagaaagcggaagaactcgccttaagccaggatttatggcttcttcgtgtcggaaaaggcgccgacagccgcgtgccgagtgtggaagaagcgaaggcttatccgtattcgccggaggaccgtaaacagattgcagaaaataggaagcggatggtgatcggctctgctgccgcagtgaaacgccgtctgcttgaactttccgaacgttatcagacaaaagagatgatggtgctgtgcaacgtctttgatttcgaagcaaaaaaagagtcatatgagcgtcttgctgatatatttctgtaaaaaaagccgtcaaacggcgcagcagatgagactgctgcaccgcttaacggcggttttttcgttcttttccttttttaaacgcattccaaatcccctgcagcataaagccgagcagaagcagaatgattaacagtaaagtgattgacggccccggaggcgttccgagctggtacgaagacgtcagccccatgaacacactgaaaagagaaataataatggccgccgcaaacacccatttaaaccctttggcgatacggattgcaaaagccgcgggcagtacgaggagcgcggaaacaagcagcacgccgataatcggaataatgaccgaaatcgccagccccgtcacgatgctgaatgacattgacaggagatttgtgttaatgcctgatgtcttcgccgtcgcctcgtcaaaggtaagcagatagagcggtctgtttaatataatgaaataaagcagaatcagcagggtaatgcctccgataatatagacctgctgctggctgaccgtgacaagcgatccaaataaatattgatcgatgctcatcgacgcgccgccttttgacaggctgatcagaaacatcgcaaacgacagcccggccgccattaagattgcgatggatacctctgaatatgtacggtatgcccgccgcatatattcgatgccgatcgctccgatcgtgacgacaacgatgctcgccgccgtaatattggtactgagaaaaaaaccgatggccacgcccgacaatgaaatatgagacagcgtatccgccatcagcgcctgtcttctcagcacgagatatacgcctaatatcggcgccataattccgatcatgcttcccgctagaaaagctcgtcgcatgaattccaagtcaaacatttccatccgcctttttcccccctctcaagccgtatgactttatccaaatactgctgtacttcattttgttcgtgtgtcaccatgacgacggtgcggttgtgatttttcacctgatgatgcataaattcgtagaaaccctgtctgctttcatagtcaaccgcggttgtcggttcatcaagcatcagcagatccggattgcttgcaagcattctcgcaatgcagattttctgcttctgtccgccggataaatcgccgattttccggtggcggaaatcccacatttccaccatcttcagcgcgttttccacctcgtggtgatccgtttcgttcaatcgtttaaaccattttcctttcgtataacggcctgattgcacaagctccagaactgtgcttgggaatcctgcgttaaatgaagaaatctgctgcggaacatagccgattgtcaggcgttttccggcagcgttttttttactgatctcggccgttccttcccaaggtctgagcatgccgagcatgactttcatcagcgtcgattttgacgcgccgttcggtcctgtaatgccgacgaattcgccgcttttgatttccagcgacacaccgtcaagcacgggtgtatgcgaataaccaaaaacgatatcctgtaatgtaacgagattcatgctgaccttcctttcccgcatagaaatagtgtgcaccccgcggcgcacactatgttatttaaccaatagcgaatctttcagtgcatcaaggtttttctccataatgtcgatataaccgatgcctttatcccgttctttttggcttaaaccttccagtgtattgagcacttccgttttcgcgccgatttcaccggcaagtgtatctgcaactttaggcgatgcaacttcttcaaaatagatgatcttcacatcatgctttttggcaaacgttttgagatccgccagtttggccgcactcggctcttcttcaggagaaaggcctgcaatcgcgacttgttttaagccgtattctttggcgagatagctgaatgccgcgtgctgtgtgatcaattcttttttcgacgctttatttaatgttgtacggtatagtttatcaagatcctgcagttttgcaatatattctttactatttttctcatagtatgctttattcttcgggtcctgttttacgatctgcgccgtaatggttttgacctctttttgcgcaagaaccgggctgagccacacgtgagggtccatgctgtggctgtggtcatgaccgccgtgtccatgttcctcttcctcttcatccgaaccttcgagcaagtcaattcctttcgacgcctttacaaacttcgcatgatcagagctcatgcttttttccgctgaaggaacccatgtctccatatattcgctgttgtatacgaaaagatcggcgttttgaatgccggcgatatccttcggcgtcggctcccaatcatggggttcgaccgaagacgggatgagaatgtctacatcgcctttgtctttgacaatttgtttcgtgaattcgtacataggataaaaggtcgtcacgacgtgcagtttgccgcttttcgaagaacctgacgaaccttttgaagatgaattgccgcagcccgccgcgattaaaaagcatgccgcaatgacaatgattccgctccattttttaaacaagccgtttccccctgttctgtaaatcagaatgatgacgatttccaaagcgtactttctcgttcatttgttacctataccataataaaacgaagtaattacgttttgcaagtaatttttttctaaattgataaccgatttacctaaaaagcccccgccatgtatggacggggcgtcgtatcacatatcaggcatgcagataaactcttgtttcgtaagggcggaacgtgatgcgggattccgctccgccgttattttcatagttgctgagaagcagctcggccctttcagattcggagccgtccggccaataaaaggcggcttcttctttcgatacgttgctgatggatatgattttttgtccgtttgcctgtctttcatacacaaacagctgcgggtcatcgggaaacagcagcgtgtagctgccttttatgatatcagcatactgttttcgcaggcggatcagttttttgtaaaagttcaatatagaattgggatcatcctgagcctcggccgcattgacggttttgtaattgggattgaccttcagccacggttcgccctccgtaaatccggcattcttgctgccgtcccactgcatcggtgtacgggcatgatcgcggcttttcgccataatggacgccatgacttcttccctgttgcggcccatttcaaatacccttttgtgatacatattgacggtctgaatatcttgatagtcctctattctgtcaaacggggcgtttgtcatgccgagttcttctccctgataaatgtacggcgtgcctttcatgaaataaagcagggcggcaagcattttggcggatgcctttcggtatttgccttcgtctccgaagcgggatacgatccggggctggtcatgattgcaccaatacagcgtattccagccttgatgttccagtttttcctgccagtctgtgagcactttcttcaaatcggacagctcaagcggttttacatcccaatgctcttggcccggcttttgatcaagctccatatgctgaaaatgaaaaatcatattcagttcatgctcatcggttcccgtgtaaaccagcccctcctcaggcgtcactgatccggcctcgccgaccgacatcacgtcatattttggaaaatacctctttcgtcatttcttttaagtaatcatgtatccgtgctccgtttggccggaaaggcttcggatctgcccggcgggcgatgtaatcttcatatggcggcaagtattctttttttgacagaagatgaagctggtctattcgcaatccgtccacgcctttatcgagccaaaatctcatcatctcgtatactgattgccgaacctcgggattttcccaattcagatcggcttgtttaacggcgttcatatgcaggtaatattcgcccgtatgttcttcgtactgccagacggattgtccgtaatccgacacccaatcggtcggcgggccctccgcggtgcccggccgccaaatataataatcgcggtatttgctgtccggattcatttccgcctctttgaaccaaggatgctccgtggaggtatgatttaaaacgaagtccatcacaagctttaatccgcggctgcggcattctgtaagcagatcgtgaaagtcctccatcgttccgtatgattccataatcgcttgatgatccgtcacatcgtagccgttatcgacgtttggcgacgggtaaatcgggcagatccatatcacatcggcgccaagctcttttatataatcgagacgcgcgataatcccccgcaggtcgcctatgccgtcgctgttcgtatcttggaagcttcgcggatagatttgatagacaacggcgtctttccaccagtcattcgccatcttgcggccctcctgttttttagagaaccatttcctgtatgccccttctctaaacaaaaaagagaaggtttcccctcctcttttatctttccagctgggacggataaagcgtcatgcctccgtctacgaaaagtgtcgttccggttacgtaactcgcttcttccgacaccatccatgcggcggccgcggcgacttcttccggttttccgaaggcgttcatcggaatttttttcagctgggcctgtttatgtgtttcatcttccagatccttattggactccgtggcgatcgtgccgggagcgatggcattcacccggatgcctttgtctgcgtaattgagcgccatcgtttccgtcatcattttgatcccgcctttggatgccgagtactgcacgttttcaggacgcggtatttgctgatgaacgctcgatatgtttaagaccgttccttttttgccgtgctcgagcatatgtttcagtgccgctttcgcccccaaaaaggtgccggtcacgttgacgtcgatgaccctttgccaatcctccaggctcatttcatggggcatcgcttccgctccgttaaagccggaattgttgaccatcacgtccacgcccccgaaatgctcctgcgcggcattaaacagcgcctgaatcccttcttctgaggatacatcggcttttacggtgacggctctgcctcccgctttctcaatgatatccgccgcttcttccgctccggcggaatcaccgaggtagttcacaaccacattcatccgctccttgccgaagcgttcggcaatggcttttccgattcctttcgaagaacctgttacaatcgctgttttcccctgtaaatcctgatacattgtctcatttcctccctgatgttaatacagagcatgtacccggttttaatcggctgaaaacaaaaggaatcataaaaagaacgatgaaaccgaagctccctcgttcttttttttattatgcgtagttgttcatttgcagccttttttgcacgccgacaagcctgctgaaaaaataagatgccgctttgtagttctcccgtttatgaaagaaatgagccgcgtcctgaagcagttcctctgtgtcagccaacagctcctttgattccaggatgtcaaaatactctttgagcgaatcctgtccgccttccccctgataaagctctttaatcagacggaatttcgtcatatagatctcatcttcccactccgccgcgcttctcatgccccgcgcgcagctggcggcggcttcactgtatttttccgttttaaagtagatatgcgtgagtgaaaaaacagcctggatgacctgccggaagctgtgtgcttcaaatccggcagccgcccgttcaaaatcctccgccgccttgcaaaagtcacccagactgtacatacagtgcccgatattataataggccgcagcaatcatatattgatcatcaagccgctccgcgtgctccaaggcgcattcgaggtattccagcgcttttttatgctgctgggcgtccatcagatttccggcaatgataaatttgcactgcacccttctcattccgtataattcatatttcttgtaaatatcaagcgcctgccccgcgtaattcatcgaaaagaaagtctgcttgatatgatagtacacctcagaaattttatacagaaactcggctttctctatgtcatcttccacatattcaagcttttcctcagcccgcttataatgagaaatcgctgagatgaagtttttctgcttaaattcatacattcctctgaaatagtaaaaataatattccagtaagccggtcagcttttgctggttcatctcaatctcagtgagcatttcagagaacggaggctggcagtcgccgtctttcatgggttttaatttatccagcatgatgcggtgcctaaattccatcaatgaaaaatacaacaataaatcctgattttcttccatatcttcgagttcatattgaatctcccgcttcagcgcttcagctttatcggcttcaaacgcgcggatcagcttataccattcattcatctttacggccacttcttcagatggaatcttggatttcatagatttgcctccttcctccggctactaattatgttatattttatcatagcaaatttatggcagtgagcaaacaaagattttaatcaattaaagaaagagagaattcaccatgaaactaccagtcagaatttcgctgcttctgatcctcttcttttccgcagacctatgtttttcctatgtgcagaaagaattgaggccgcagacggcattacaagatagagccattccaagcgctcttcatccgctcgtgaaacagaatgcggagctattgcggacggccgctctgaaaaaaggcatcaccgtcgttatcacagagggtttcagatcaattgaggaacaaaacgaattgtaccgtcaaggacgttcaaaaaaaggaaatatcgtcacctacgcaaaaggcggggaatcttaccacaattacggccttgcgatcgacttcgccctgcaaaaaaaggatggaagcctgatttgggatatgacgtacgacggaaaccgaaacggcacgcccgattggcttgaggtcgtatcgattgccaaaacgctcggttttgattggggaggcgattggagaggctttaaagattatcctcatttacaaatgatccctggctaataaaaccttttcttttttcgcttctgcgcatcaatgtacggaggatagacaggcctgtacacaagcttatatccttcattgccggacggcgtaaaatcgcgctgccactccagccgcagatggaaatcggataaaaaagcggcctttgcttcttcgggagtaacggccggcaccggattgatcttctccagctgctccgggtcaatgtcaggcgccatataagcttccacaagccccgttacgggactgacaagtattctcgcagcgccgaaccgcagcggaatatcctgatgccatacggaaaaatggaagcggaacctgccccttccgtccgttttcagcgggttcattttaaaaaactcgtccgctctcggataaagcttgtataaaaattgaagcgcgacggcctcacactcttccgcagaataaaaggccgggccctgatgctcaataaaagatttaaaggctgtcattttccctgtctttttgtccgttttcatcttcattgtatttttgttgctggtttcaaaatagctttcgatactcaaatctttccgttccggaaccgaccctttccgccatgtcgttccgatctcatccccgagatcgcgccggcgcgtctgaaccatatccgaggtaaaccccatcaattcatccaggctgatttcccgtttatgttcaaacgcaggaagcggttttgccggctcattcctgtcttcgcaaagctgctgatccggcacgatatcatcttcaccggccggatagctgtaagccggcagaatcggttcatagacgagacgcggtatgttctcaaaattgaccacatcatagacgagactgaatgtcagcacactcatataatgcgagacgactttttcccgatcgacgaatgtttccgggacgggcgcttcacccttatccccgtaatagataaactgcacgacgaagccgctcctggttacatcaacgaaaaaacctgaatcgggaagcggccggccgagcactttttttgtatagataaatcggatgcacccattgcgttcttccctcgcctgaaagatgaaattcataaaagtaagcgggcggtgtctcgccgcaaaccgaagagccgtcagctttaattcggcgtctgacagctgcatgtctgaacccggacagtcgttgcgtgaataggtaagcaaagatccgtcgtcgcccagctcaatcgttaccgttttatccggatggttacgatctttccatatataataggctctcgttttttgtttttcatcataatcttctatttcaagctcatagtgcggcggtatgttcccgatctccagcgctttttttctcagatgttctttcagcaatggggtcatcctttcagaagagtgtataaaaaagaactgtttttaattatataaaaacgtccttatccttttaaagggaagaaagtgccttttatgtgtctatttttagcaaagagggaaaagagccgtattcagagcggctgtttttcatacaatagtcacaattcccgcaaaagacccgggacgaacgcccatgaccttcagcctattaaactcgtgatcacttctcccgtatgggcctcaataaaccgcgggaaaaccggcttgtatacgagcctgtacacttttccgcagctgccgtcatcgtaacaacgatcccaagcgagctcggctttgatggcccggcggatcgcgtccttcgcctcttccattgtcaatgaaggaacgggatcgatttcctccagctctttcggatcaatttccggcggcatataaaacgtgacaagacccgtctttttgctgacgcagattctcccctctccgaatcgcaaatcaacgccgcccgaacaagccttatatgtaagtcccacgttttctccttcatcatccggctcatcatattgaacccggaaatactgatccgcttccggaaacatggcgaataaaaagcggatggccatgtgatggcattcttcctcggaaaactccggttcgccttcactatgtataaatgacatcactccggcgagccggcccgattctttatcatgcattgttttcaatacatgttcattccgttctttaaacagactttctaagcttttatctttccggacggattttgttttttcaggacgccatgcaatgccgatgcggccgtctccaagatcagtttccctctctttataaaaaccgtcgtgcagcccgatcatgtcattgatgctcatcttttccgcttcaggtgcagggcgtgaaatcgggacatacggcagcatgtcgtcttccagcccttcatattcgtctatttctgcattctcttccttcaggtcagccgatatcggccgcgtcggagacacgatttcatagacgagatgaggcttgtcatccccctgcacatagacggactgatgcagtacggtgaacaacagctccgcttcaatatgtttgacaaagtgagccaatgcttcccgcttgtccgcaattgttccgggtcttaagagattatcagccttcccatggtaagaaaagccggttacttcccctgtcaaagacaggtcggcgtaaaacccggtcagcggaagcggcagaccgtcagccatctgaacataggaatatctcacatcaccatcatttgcggagccgctgttttccaattcgaactcagccaatgcccccggacgatgggtttctacaaacgcccgcatccgttcttctatgtccgattccgaaagagccggcagatcagtccggaaagccggacgggataaggatttcagttttccgtcccggtccaattcgaccatgatgccggcttccggatcattcttatcttcccaccaaaacaaaacctcatcttcttggtattcttccacattactttcgtagcgggcaggtacgttaccgatccggagagccagctgtttcaattcttcttttttcatcataacacttccttttcttccaaaaagattgatgattaccaagactcttttatacaaaactagtataattaacctgtctgtcttcatgactattgaattaatcattataacaacagggggtaaaccagatgtccatcaaaaaaatgagcgccgtgtttttcatactgcttctcacggcatttaccgccgcatgcagcagcgaaacgagcggcggccaggaaagcagcacggcgaaagtgaaaataaaagagacggcatgggccgcttcagacgatactgaacatccggccgcgctgaaagtaacggtcaccgtcaaaaatacgggcaaagacccgcttaccgtcaaaagcagcgacttctcgctttatcaggatgacgcgaaaacagcggcggccgataaggatgaccagatgcagagcggcacgcttcatgcgggcaagacagtgacgggcaatctgtacttcacggctgacgaaggcaaatcatatgaattggtatatcagccgcaggcaaaagacgcgaagcctttatcttataaactgaaagtcaaaggcacagcctcaaacgcaaaacctgacccggcggacgcattatccgcatacattgatgtgatgctgtacggcaagcacaataaagatttcacccgcctgaccggtgtaaatgaaaaaatgacggccgccgcatatcaggaatcggcgaaagccagctttatcgcttctgcaggcatttcacaagaacaggcggattcaaaagccatttccgctattattgacgccatgtcatcagcgcttcgggataacacagagctcaaggtgcataccaaatccatgtcaggcaaaaaagccgtccttgaagcaaaagtgacgccgcttgatatgtctccgctcgcgggccagctgcaagaccgcgtgcaagactatgccggaaagcaccccgatgctgatgaaaacgaaattgtcagccacctgctttctgtctatccggaagagtttatgcgcctgaaaccggcttcttcttccgtaacaagagaaatcgagatgaagaaaaacgcccgcggccagtggtatctggatacagacgccgatctggaaggattgacagaagcgtttttgaaaacgtcctgacagcaagaaaggaaatagcgcaggctatttcctttttttattttcacttgaagatgtcactgatatattgaacctcatcctcggtcaattgcacatcaagcgcgcccagattgtgtttcagctggccggggcgtttggctccgggaatgatcgcatccaccgccggctgcgacagaagccacgcgagtgcgatatgcgctgtctgcgcccctttttcttccgcaacggcccgaagcttatccactcgctccaggttttggtgaaaagcttctccctgaaacggcggcctgttttttcggctgtcctcaaagactgtgtcttttgtaaactttcccgtcagcaagccggaagcaagcggaaaataaggaataaaagaaataccgttcttttcacaataaggcagcagatcatgctccgcctcacgctgaatcagtgaatattctgattgaaaaacctctaaataaccgtcggcgttaaactcctgcaattgcccgaagctgagattggacgcgccgattgctctgattttcccttcgtccttcagttcttttagcgtgcccgccacttcggagagcggtgttttgccgtcagggaagtggacgtaatacaaatcaatcacgtctgttttcagccgcttcaggctgttttccgcctcactacggagaaattcacggctgttgtccagctcgatttgtccgttgacctctttgtgcgcgccttttgacgcaatcacgaggctgtcccgcacgccgcgctctgcgacaacttcaccgattaactcttcggaacgccccaaaccgtatataaacgccgtatcaataaaattgacgccgccgtccaacgctgtgcggatgagttcttttcccgtttcatcattaagattcggaaacagattatgtcctccgaccgcattagcgccaaagccgatacgctttacccgtaaatccgtcctgcccagcgtacgtgtctcatccatggctcaggctcccttccttttatcgctctgtttagtattagataactggtaagaattatcctgccccgagagcatttctgcagaaaaaaccttgaaaagcatgtgcccttcaaggttttttggctgtgtattaagatgtcagagctgcggcgaagcgttcggcttcatctgtgagagcaccttcgatttccttatagcggctggaaatcgttgaggcgctgacgccgtacttcttcgccagcttggcttgagaaacggacgcgccgttcagagaaatactgtttacgtaatattcaaccgccgccgcgaaagcttccggctttctgatcgtcggtgtttttttgacacagaacgttttccacaggtcaataacggccggaaccagctcagccgggtattcatccccgctcaggcctttttcaatggcgtccgccgtttccttctccatgtcgttcgcccactccgtctgtttttcttcagcagcctgctcaggctcttccgccgttcctaaaagagcggccagcacagtgtcgaagtcctcctgcataaagcgctcaggcgattttccttccgcaagggccggggcagccgcctttttcactttgctgattagagcttcggtccgcttcacagggaagatcgtaaactgcataaagaactccgctttttccgcttcgtggatcggatagccgagaatcaggcttcccgccggcggaagatcctgctggctgacgtccatttccactttgaattgtttcttggtcatcacatcttcaaagtgaatcattccttctttcacatcttcaagcaccataaccgctggtgtcatgcttttccatgattcaacgatttcccgtgttttcggacggttgatgccgccggcttttttctgaagatattcttcaaaaatcgtcttgccgcctgccagcggacggaagaaaattccccagataccgaggttgaagactccgatgtctttagtctgtctgtccagctccgtaatgaactcatgctggttaataaatgatgatatgccgtctctatgtgctgtaaaggcgtactccattaagctttcctgaatctgtttcgcttcttttgccgcgatgtctgccggaatggcagcttctttgcttccgcagcattttttatatttcttcccgctgccgcatgggcaaggggcatttcttttcacttttcccacaataaaccctccgaattctgatataactttattattttaacaaaaataacttcagagggcttggtttacggcgaaaaaagaatatggaagaaaaaaaggccccgggatattctcattctccggggctttgaaactgttaatttgtattttgtccgccgccgttcagaccttctttaatcagcccgtttacttggctgttcatcaaaagtccgatgtgtccgacaccgtgaatctgcacgtttttcccgccgatcagtcgtgacagcgggttcagaacgatcaagtccgctgagctgtaaatcgatgtatataaaatcttttggttcggatcagtccccggaagcgcccggttggtcacaaggccgttcgctccgccgagtgtgacgacgttggcgattttgtctccgccgtcaagatttttaatgtaatagagcgtgttggcgccgcccatgctgtgcgcgacgatatcgacttttttcgcacctgtttcgctgagcacttttttcacgtaattggacagtctcggcgcattgtgtctgttgtttccggttttgtctaagaaatcaatagcgtacatctcttttcttgaccagccttgggatgccaagtatgttttgattcccgcaaagttaaaagacgccccgccgattccgtgaaccatgactacagggttatgccctgaggaggctttcgatacggtcggctggaaggcaaatacggaaatgacggacagcatacaaactgtaaggatgactaggattttgctttttatatgtttcatgaactttcctcctgctatgtaatatttttgcagttttcattctattagagaagaaaaggaaaaaatagtgtattttttactgttttcaacaattaaaaaagagcggaaaaatgagaaagacgcccctttcccgaaagcacgcttatgctttaatacggcataccgacaaaggagagaacacccggttctctactcctagtactcattgaaataggtttgaatccgcttaggatcttgcgtttttgtcagcgcgagcatgagaagaatccgcgctttttgagggttgagagagtttgaagctgtcaaatggtctttttcatactctcgattaggtgttaccgccccgtttcccgtccttgtggagcggacgaccgccagcccgcttttgaccgactttacagcgccttttagcgccgcatcagacattgagccgtttcccgggcctgcaaaaataatgccttgcgcccctgattttacggcggcttcaaagagatagcttccgtcattttgatagccgtatataatatcgacctgcggcagtttatcaagtttatctatcttgaaatctgtatccttcgtatgctttcgggtgatgatgttattaaaatagacgtcatcagcaattgttccgatataacccatttcttccgatttgaaagtgtcggtcgcggttgtattggtttttgtcacataacgcgccgaagcgattctgtcatttaatacgacaagcgtccccttgcctttcgcctcaggcgcagccgctgtttttaccgcgttatataagttggacggcccgtccgctccgatcgccgtggacggccgcattgacccggcgacaacaacgggtttgtcactcttgaccgtcagattgagaaagtaggcggtttcctcaagtgtgtctgttccatgtgtaatgacaatgccgtctgtatcatcagacttgagcagcttgtttacccgttttgcaagtttcagcagtgtctcgttattcatattctggctgccgatattcacaacctgttctccgctcacatgcgcggcctcttttatctccggaacggcctgaatcagggcatcaactccgattgcccccgccctgtactccgtagcggacgtctttgaaggagcagcgcctgcaattgtgccgccggtggcaagaattttaatattcggaagtccgtcttttttcgcagaggctgcggctgccatctggggcggtgtttctttcgtttgaggagattgggagcagccggccgcgatgaagagcagagccgtgataaatgtaatgaagggcatgaattgttttttcattcttttctctccttttctttatttatgatgattttcctctcaccggtcaacgcgcttgtcaggcattcttccgaagaaaataaccgttaaaaaaccttgacaccgtcatgcgaaatcaagataatagaccagtcactatattttaaatttgtcacaaatcagtaaggtgggaacattatgagctatggagattctcgggaaaaaatcctcgccgcggcaaccaggctgtttcagcttcaggggtattacggcacgggactgaatcagattattaaagaaagcggggcgccgaaaggttctctttactatcattttccggacggcaaagagcagctcgccattgaggctgtcaatgaaatgagccattatatccgtatgaaaataaaagaaagccttgatgctcatcttgatccggcggaaagcattcaagcgtttttacaggacttatcaagccaattcacatgtccggagaattttgaagggtttcctgtcggtttactggctgccgagactgctttaaagagcgaaaagctccggcaggcctgtcaaaacgcttatcaggaatgggagaatctgttcgcgggcaaattaagatcagccggtttttctgatgagaaagcggcggaaatcagcactgttttaaatgccatgatagaaggcggcatcattgtgtccttagccaaaaaagacaaaatgccgatcctccatatttctaaacaaatccccaacctgctgaagacataaaatacgagagacatgtacgtatagaaagagaggagaatgattttggaaaacgctcagccttccaaacaatataaagtcatgccgatcatgatttctttgctgacggcagggtttatcggcatgttcagtgaaacggcgctgaatatcgccttgactgatctgatgaaggagctacatatcactcctgcgaccgtccagtggctgacgacgggctatctgctcgttctcggtattcttgtgccggtatcgggtctgcttttgcaatggtttacgacgagacagctgttcatcgtttcactcgctttttccattatcggcacgctgattgcagcgcttgcgccgagctttccgtttcttttggcggcaagaatcgtgcaggctttaggaaccgggctgctgctgccgctgatgtttaatacaatcctcgtcatcttcccgccgcataagcgcggagcggcgatggggacgatcgggcttgtcattatgttcgctcctgcgatcggtccgacattttcagggcttgtgctagagcatttgaactggcattggattttctggatttccctgccgtttcttgtgttggctcttttattcggcatcgcctacatgcagaacgtgtctgacattacaaaaccgaaaattgacgtgctttccattattctgtctacgatcgggttcggcggcatcgtattcggattcagcaatgcaggcgaaggatcagacggctggtcaagcccgacggttatcggttcgctcactgtcggcgcgatcgcgctcatcttattttccatcaggcagctgacaatgaagcagccgatgatgaatctgcgcgctttccgctatccgatgtttgttctcggtgtcgtgattgtgtttatctgtatgatggttatcttatcgacaatgctcctattgcctatgtatttacaaagcggactgatgctgacggcgtttacgtccgggctcatcctgctgccgggcggtattttaaacggctttatgtctccggtgacggggcgtctgtttgataaatacgggccgaagtggcttgtcattcccgggtttgtcatcacggcaactgtgctttcgtttttctcaaacattaacggcgcttctacggcgcttctgattgtcgcgcttcatacatgcctgatgatcggcatttccatgatcatgatgccggcgcaaacgaacggcttaaatcagctgccgccggaattttacccggacggaacagccattatgaatacgctccagcagatggccggcgcaatcggcactgcggtggcggtcagcatcatggctgccggccagaagaattatatgagcaccgcgaaaaacccgaatgatccttccgcatactctcacgcgctgattgcgggcgtccagcacgcctttatctttgcgatgattgtcgccgttatcggcttgatcagcgctttctttatgaaacgggtcaaagtgaatcattcataagaaaacagcagactccccgtgagtctgctgtttttttatataccgcgcgcttcagccagttcatcaatcgcatagatcagatcgtcagctgtgttatagaaatgaggcgccagccggatgatttgtccgctggatgcgcatacgatgtttttccgcctcaacagcgcagccgtttccgccgctttttcatcccgtatggaaatcatgccgggtctgtcatcggcagacggcggccctgtgagattcagtcctttttcagaagcgtattcatacgcaaatgcgctgagtttttttacttcttggtgaatgcggtctgtgccggcatcgtttaatagagataaagccgcctgtgccgcatatatgctgataaatgccggggttccggtctcaaagcgtttggctccgtccgcataagaaaaacgggttaaatccggcatcgacgcccgctgctgcccgaaccatccggtgactttcggcttcagccgttcggcaagttcctttctgacataaagaaacgccgttcccggtatgccgagcatatactttctcgcacccgcggccagcatatcaactccccattcttttacatcaatcgggatgtgccccgccgattgataagcatcgacaaaaagaagcgatcccttctttgcggatatctcggcaatgcgctttatatcctggacaaaacccgacgtatatgacacatggggcacacaggtgaaaagcgtctgctccgatatgtacgtctcataccgctctaacgggatcattccatcttcagacggcacgactgaaagctccatctcagtctgtgccttcaaaatgtgggcgatcgccggaaaatccaattccgtatacaccgcctgtttctttcggcaatccggtaaagcagaaacgacggcagagacagcagccgttactgaaggtaaaacggcgatttcttcaggatgggcgccgatcaattttgcaaattcacaccttgcctgctccgtacgtccaatggcttcttcccagtttccgccatgctgaaacaggctttcctgatagtcattgaccgcttttgaaaccggcagggcaagagcgctttgagagcagctggcgagcatcgtatgtgtgcggagcaccggaaataaagatcggtattgcaccagaggcgaattcaagacatggttcccccttcggcaggaatatatgtccattatagagtatggtaaaaagaaaaggagggttttatatggagaaaaaagtattactgacaggctttgaccccttcggcggggaaacggtcaatccttcatgggaagcggtcaaacggctggacggttcccatgaaggccctgcctctatcgtatccgaacaagtgccgaccgttttttataagtctcttgccgtgctgcgcgaagcggtcaaaaagcatcagcctgacattatcatttgtgtcggacaggcaggcggcagaatgcagatcacgccggaacgggtcgcgatcaatctgaatgaggcgcgcataccggataacgaaggaaaccagcctgtcggggaaaacatttctcaaagcggtcccgcggcctattggaccggccttccgatcaaacggatcgttgaggaaatcaaaaaggaaggcattcccgcggctgtatcctacacggcggggacgtttgtatgcaatcatctcttttacgggctgatggatgaaatcgcctgccatcatccgcacatccgcggcgggtttatacacatcccgtacattccggagcaaaccttgcagaagtctgcgccgagcctcagcctggatctcgtgacaaaagcgctcaaaatcgccgcggtgaccgccgcggcgcatgaggacgatattgagaccggcggaggcgagcttcactaagcggcagacacctcggcccatttcttccggtaaacgatgcgggacagcgtcacactgatttcatagaggacgagcagcggaatcatgacgagaaagtcagacataaaatccggaggcgtaatcagcaccgagacgacgatcagcaaaaaatacgaaagcttccgcgcctttgccagccgggttggattcacgattccgagccgtgtcagaaacatgacggccagaggcatttcaaacaaaaatccgaacggcaatgtaagattcagcataaaggtaaaatacttgtccgccgtaaataccatgtcaaaatggccggcggataattgtgttaaaaatccgagcacaatcggaaacagcacaaaatacccgaaggaaattccgataataaacaaaagcgaaagccccggaatgtaaagcaaagcggcgcggcgttcgaacggggtcaaagccggcgccgtaaaacgccagagctgaaaggccgcaaccggaatcgctgccgtaagggcgcatattcccgcaatcatcatatacacccataaaatctcgctcggccctaaaacggccagcctgccatgcaaatccttgatcagccagtcataaatatcctgcacaaaccagcaggcgccgataaaaaacacgagaaaggcgataacgattttaatgagacgctgccggacttcctctaaatgcccgatcaagtgggtttcttttttatccaatcgtacatcctccttatagagaaagaggcagaagcggattcgtctgcccccatgtcaggattcagcctgccgttttgtctttctcagccgtctgcttgtccggctcttcatttgagaccaatgtttttgcggcgcttttaaattcaagcagcgtgcggccggcggcacggccgatttccggaagttttgaaggtccgaaaatgatgagagcgatgacgaaaatcaggatcaacccgggaatgccgatatttgaaaacatgagtgtgcctccttattgtgagattttggcccgtttctttctcatttgcttttcatgcgcattgttatgggcgaagaaacgatcctcttccacctcgtttgactgctttaaaccgcctgcaaccgccgcttgagagaccttccgaatccccgtctggtctttctgataaatgaatgaagcccgcgtggatacctcagcccccggctccgtcacgtacggcaccactctgtaatccgctctccattgggcaggagtcaccgtacagcggacatagccgcggtaatcgttgaaaaacttaatatgcgggttttgttttaagatctgatccgtatcggcccgtttatccgccccgtttcctccagatgtaatggaagtcccgacgaattcggctccgaaaatttttgaattcgtttgattaaaatcggtatgcaggtttgacgcccagcttgcatgaacatcacccgtcagcacgatgacattgttcaggtttttgctttttataaaattgatgacccgctcccgctgagccgggtagccgtcccatgaatccatgctgtatatcggattggcggttgttccgaaattccattgcgcgaaaaagatttgctgcgccagcacattccacttcgcttttgaggcggctaaatttccgaagagccattgctcctgctctgtccccatcaatgtgcgcttcgggtctctccactcatcagaaggcggcttattcccgtcgccgttggcctgatcatctctgtactgtcttgtatcaagcacattgaacgatgctaaattgccataagaaaattgcctgtacagccgcatatcaggaccgttcggcaatgacatgcgcctgagcggcatgtgttcataataagcctgataagctgcggccctcctgagcacaaacgcttcaacggattggcctttttcagggataacattggcataattgttttccacctcatgatcgtcccacgtcacgacccacggaaatgcggcgtgggcggctttcagattggcatcagagcggtattgggcgtgacggttgcggtaatctgacagtgtgtacacttcggcgctgctgtgcgtcctgacatttcccgtttttgacacatattcgttcggtccgtattcataaatgtaatctccgagatggaatacgagatcaagcttttccttcgccatatgtttatacgccgtataatagccgtgttcatactgctggcatgaggcaaatgcaaacgtcatggccgatacgtcagcgccgggagcgggcagcgttttcgtccggccgacggggctgagctcatgcccgcttttaaaccggtaatagtacactttattgggcttgagcccgtccgcctcgacatggacggagtgtccgagattcggcttggccatttccgttccgcgtttgacgatgtgacggaaatgttcatctgcggcgatttcccattttaccggcacggcctgcttcggcatgccgcccccattcagcgggtcaggggcaagacgcgtccagagaatgacgctgtcagacagcgggtcgccggaagctacgccgagggtgaacggatagtttgaaaatttcggagcggcattcacttcaaacgcgccgatggattgcgcgatcgctaacccgagggaaagaccggcgattttcccggcgccctgtataaatgcgcggcggtcaaacgtattgttctgaaagcttttgttctccaattccttgatccattcatctaaacggccgtcatgtgtcatgtcagttcccctttcgtcttattgatcgcccttattataaaaaagaaatgttaaaccgctatgaagaagtgtgaagggtttgtaaggctgaaaaatgaacggcgggagacatttttcacattgtttcgacaaaccttgccccgccggaagaaaaccccctctgtttctttttggcttgtcatccgtcaagcgcacttttttcctatttttcttcacaaaacattaaaaaaacaccgttcattttaagaacggtgcccccgggattaaaatgtattgtacacgttttcgcacgtctcacctgtcggctgatagaagcagtgggatctgaatctggcgacaaacggctggccataccaagtctgcgggcagttgcccggcggcttaaagtaccacagactgaacttagccggccaaaaccgttctccgttaatgttcctgcgggcaagcctccgctcggattcacgcggtctctggtaaaagtatccgtgagtcaccgcttcaaacgcgtgcggctgaaacaccatctgcctgatggtgcgcaggcctttaaaatcagaacaattcgcccgcacccgattgattcccacattgccgaccaaaagcattccctgcttcccttcgccttccgcttccgccctgagcagccttgccattagatcgacatcggcgctcgacgcttttacgactgccatcatgacacctcccgtattttctcctttcatcatattcagcagcggcccagtgatgacagccaaaagccagaaaacaaatgttcacgaaaaaagggtttatatttcacgttatgaggaaacatactaacatgatttccataaggaggaattcgaatggaacacattaaagcgcttgccattaaaggcattatgaccatcattattctgtatctgatactcggcttaggttttcgctttacattcggtgacgtgctgctgatgaccattgtgctgggagccgtttcctactttacgggcgacctgtacgtgcttccgagatggaataatatcacggcggcgtccgctgatttcggaatcgcgtttcttgttgtctggctgatgggaatgccgctgtccatgggcatttccggaggaagactggcgtttgccgctctcatttccgccgtcatcatcgccgtcggagaatattttttccatatctatctgatgagaaaagacttgggagggtcccgttttttagaaccccggtccgaataatgtaaaaaaggccggataacggccttcagcttgtagagaaaatgatgttttttctgcaagcttttttgttttttgctgtttctttacatatgcccagccttgcttggctgggtatgcggcaaccttcaacatcattttgaataagatcagcggatcaagtgaggggcggcctttattttcgttgcagtaaggtttgaccttttcaacgataaaagagaagtctatgtactgatcaatttttcgaagcaggtgatcctcttcaacgagttggtcaaacagaacgaattcggctgtattttgagaagcgtctcttgtgcgggtcttttattatatgacaggggaatggatattttaagggaaaaataaaggctgtcgagattttctagacagcctgagccccttaaagggggctttttatttgtaaagtaacgctttatacatcttgatataactgataaacccttttcagccttttttcgagctgttcaaaatgaacaaagcgggcttctctcagaaactcagtcccatcaatgaacaaaagaagcacggggacagtgaagactgaaaatctgccggcaacctcttctacctcgtcagcgttggtatgccccaatttgatattcggaaactgatccaaaacttttctgagctgcggcagaacagcgtgacatactgtacaggcaggtcttgaaatgtagataaaactgaattgatgctgcttaataaaattctcgatagaatctaatgaatgtaagtctgtcagctctttcatcaaaaccctccttcaaatcggctcgtctttcatgaccaagctcatcaatactcgtacattcactatacacatttatattgatcatatccgcttttttgcgattcagagcaccttaacgtcgtgcttgaaaaataaaagaacagttaccgcttttcagtaactgttcttagatacttatattaaaaatgcaaagcgtaagctcctgaaccgatgagtgcaactccgatggagactgcaatcagcaccacgttatattcaaaaccgccggcaccgttcgcaaaccctttcgctccatgaacttttacaatggcacctaacataatgatcgttatgatagcagctccaagcgggaggaatacacctaaaataaataaaattccgcttgcgagttccccgagacctgataaagcggccgcggcattgcctggtttaactccaattgactcgaaccattgtccggttcctttaatcccgtatccgccaaaccagccgaataatttttgtgatccataaaacagaaacaccacaccaatcatgattcgaataagtaatagtcctgcatcttccatttttatctctcctcatctttgatttcatctgattctttgctggacggtaccatccagcaatcatcaattgactatatgtttctttattttttatgtgtcaaatcaatctaattctcttacttcaaacggcagcagcccttgttcaatttgtgcccggtgcggttcatactgctcagggagcatcaattttccgcccattgtttcttgtgactcatcatgggcaaagcccggcggatcagttgcgatctcaaataagatttccccatgttctctgaagtaaaccgcattaaaatagtttctatcctgaacaggagtcacaccatatccgtgcgcagcaatgaatctttgccaatctaattgatcttcgtcatcctgagcccgccaagcgatgtgatgcactgtgccgacacccatttgtccgcggccgatcggcgttaatttaagatcaatcacattcccgatatcaccggcagaacgataacgaacgaagtctccttccttgccgactcgctcaagccccatgatgttttccagcagttcacctgttttttcaggctgtgctgataacagggttgcaccgccaaagcctttaatggcaacatccggggttacatctccgaaagtccacgtattggcctcccctgcttctctttccacgatttctaaatgcaggccatgcgggtcatcaaattctatatattgttccccaaaacgctcgatttttgtgtatggcacgttgaacttttcaagtctcttttcccaaaacgccatagcacctctcggcacgacgtaagatgtcacgccaacctgtccgtctccaatgatgccttgacgggcgtccgcccacggaaagaatgtgatgattgttcccggcttcccgccttcatccccgaaataaaggtgatacgtacccggatcatcaaaattgaccgtttgcttgaccaatcgcagccccagcactccagcgtagaaatcagcattctcttgagggtggccgacaattgctgtaatatgatggattcccatcgtttttttagccatttttatgcgctcctttataaatatttaaatatactccacaaactcattcacaggctttcggtagccgcgcggccttctgctttctattttttctttcccgattgtaatcatcatgacgacctcaaattgatcatctatattcaaaatctgtttcacggcttcaggatcaaaccctatcatcggacaggtgtcccagcctttttccttagcactcagcataaacatcatcgcagaaagtgaagcatttcttatcgcctcatctctcttaaacagttctcccctgttttcataaaacgaaacggtgttttgaaccatgtgatcatactcttgtttatttaatacccccagcaccttcaatccttcatagatgtcagccgcttgctgatatgcctgcttatcccctaaaaccaaaagaaccgctgatgagctgaacactttatattgtccgtttgcggcctgcttcagcttttcttttacctccgggtcaagaaccgtcacatattttgtatgctgcaaattaaaagctgatggagccaacgcaaccaattcaaacatttcgttgagctcatctcttgtgattggatgttctggaagaaagttgcttgcagatcttctttcattcaccagctgtacaaattcagccatttctctcgcactcccctttatctcgaattcgagatattatggtataaaaaatcaaataatgtatgatcaaaaaacaaaacgatcggcaggttcttatcctgcactctaattaaattgtctcgaattaaaatatcttgaattcaggataataataaaagataaatactcaaatgtcaacagttcatttttaaattcagcgcaattttgtttatgtactatttagccctgctccaactttttttctgtcaccttatttattagtaaacaggaaacaaccttgctatagacccactcgaaactgaattgatatgataagcaaagtgattacacaagaaaggatacggagagcgaatcaagagcgctcctatttttttgtgcagttttataggaggaaaaaatgacaagtgaaagagaacaaataagcaaaaaagttgctttgattgcattgatagccaatctgatcttaatggcaggaaagatcttttttggactgataggcgatagtgaagcagtttttgccgacggtatacattctgcagcggatgtcgtggcttcaattgctgtcctggccgtcatcggcatttctaataagccgcccgatcaagaccatcctttcgggcatggcaaagctgagatcatcagcgaagcgattgtaggaatcatattagtgctcgtttccgtgtatattctgatagaagcgatttcgtcctttgttgaaggtccaagcatcccgcaatacagcgcattgtttgcggctctgatatcctacgtggctaagcagatcttatatcgttattcgatcaaacaaggggaaaaatggaacagtaaagcgattatagcgattgcatacgatcataaaggcgatatcgttgcctctcttgccgcttttatcggcgtcctattggcgattatcgggaacacacgcggatggtcctatctgttgtacgccgatgcaattgccagtgtcatcgtggcgtacctcatttttaagatttcaatggaattaatcaggccgtctgttgacgttctcatggaaaaaagtgttgatcccgaactgatagaggaatataaagcggttattttggattgccctcaagtcaaacggctcgataaaatccgagcaagagaacacggccactataaattgcttgatgtccggttatctttggatcatgatttgacgattaagcagggacacgatatagcccgggaaatccgaaatgaaatcaaaagacacttttcagatgttgaagaagtgctcatccatgtgaatccttattttgaagaatgaaaaagcagcttgtagagaaaacgatgttttttctacaagcttttttgttttgtgctgtttctttacatattcgtttgatttcactgatccatatgctttctgataaaatgcagcagcgtgtttccttgagcggtcaatatgacgcccttcgcgctgcacttcggacagggcgtcccttctttctcctcgccggttccttcacaatgcggacatgtgagctcaagatcgtcggttgcgatcaccatgaatatccctccttttttgattgtctgtccgtctccagtcactttccatggccatcacctccttaacaacgcaaaaaaaccccgtccatcaaaggacgaggttttcgcggtgccacctttattaacggctgaagagccattctctcaaaaagtacagaaactcagggtttcaatactcctatcttgataacggggaaagaatcccggcaccgcctactgttatttcagcgcagcaattcagaagcccattcggcaccggacggggatcggttcacagcggccaccgactctctgaaccccgcgcgctgatgcgtacttactcttcctcagcattgttcatccgttctatgattttaaaatgtatcatacgctgtcatccggcggaagtcaataacctttcggatcggacagtccgagcatgtcccgcgccatttgcatatgctcctcttgccccgtctgaagcgcgaacttcgccgtttccacagggtaagcggcctgccattctgacacatgctcctgcattttcggccagacgcgcccgccctcagcttcgtagctcttcatcagccgttttgtttctttttctcctaatatcacttgataaaggacaaaatccttggccggatcggcaacctttgcctccgtccaatcgaggagacccgtcacacgctgattttcgccgatcaaaatatgcggaggatgcaagtcgccatggatcagcgcagaaaaatcaggccagtacgagctgtcatttatccacgtttgccatcttttccaaagctgttctgaaaccccgatttctttttttatatgatccattgattccgccgccctttgcctgacgtcatccggttttatgatttcaattccggatctggaggccgcatccgtgtctgccccgtgcagcccggctaatgctgcggcaagcgagccgacaaaaccgtctgaaggcggctcgtgttccatattccagacatactgtttcttatccagatcaattgcggcagccggtattccgtccagtttcggataagcgatcagttccggtgtatgaatccgccaatcggggactgatacagcggcatggctgcggagaaacgcgagaacatcgctttctgcagccgctctttcgataacatcgggacggcgcggctttcggagcacccatgtcacgccgctgtcatcttcagcaaatacgacttggaagtccatacccgtttcatttatgtccgccccttcatattttaaccgtaagccattttcctttgcgatgttcaaaacggattctatttccctttgtttttttgtcatcttgtttccccatttcccttattgactgacacagagcttcgcctttaggcggagaagaaagagatgtgtgaagacgccaaaaagagggcggcataatcgccgccccctcactattactgtcaggttccttattcaggcagacaatcccggtttcctccgcgctcaaggcagagactttgacactatttcattagtgcgaaaaccggaatttgatcagccatcaggatccctccgttccttcttagttaacattattttacacaaaaaccttatatacgtaaaccctatttatcagcttaccggctgcctccgctgacaaattttgatccttcgcgtaaatctttcgcctccaaaaaaaagacgtgaatgaattttttcatattcactttaaccggagaaagcggcacggtttccttggcctgcatttctttcattctcttgctgacagcggggaaatcaaagaatttcgaggcgtaatattcaaatttggggtttgaaaaatcagttgtgcccaatgaagcgaaatggtttaacgaatgaatgacggcccttctgatccgctgttccgaggctttgatttctctgttaacctcggcttgtgccgccgcaggtcccagcttccggatggcggcgtttgtaaacatctgctttaaagacgggatgtttctttccgcctgttcatcctcaaataaatagtgaaggacggccatgaggtcatgcgccccgctttctcccacgatgcctaattccgacaaaagaaattttcctgtttctttgattgatttctcgtgcatcccccccggcccgctttttttcggctcattccgctgaataagacggcttaacgagtgttggatgtcgccgatcgaggtttccagttcaatccgctcttttacttttcgcaaaacggtgacgatctcgattttgttgatcggtttatggataaagtattcgatgccgagagaataagcttctcccaccatttcctttgcctccacctgcgatatcatcactgcttttccgttgtacgccccctgaagatgccgtatcgtctcaatcccgtcccggcccggcatcagcagatcaattaataaaatatcgacttgtttgaaatggagataatgcccttcaatctggcttccgtcctctgcctcaccgacgacttctcctaagtcctcgtcctcgatcatctgttttaaaatggaacggatcgcccggtcatcatcagctataaaaaaacgcatattatgagttcatcctttctgcaatcaaatgcttcaccggcagcttaatcgtaaatatgacgccttttggcttgttatgaaaggaaatgtctccgtcaagttcggttacgatttccttcacgtatgaaagcccgatgcccgttgaaggtgcgccgaattcatcgtatttggacgtaaaaccgggatcataaacgacctctccgattttttccggaatgccgggaccgtcatcttccgcctcaaattcggccatccccccctccgccctgcgcagcgcgaggcggatctcacccctgtcacccatggcttcgacggcattggcggtcaggttatttaagatcgacaggacggtaaagacgtgataatcggggtgttctccttcaatcacgtttttgaattgaatgtctttgcctaaagattcggcgtatttttcattgatgcggataacgaggccgaccagatcggcggcattcatgtaatcccggaatctctcatttgaaatcagcttcgacaggccggcgaatattcgctgattgtcttttttcacttcatgaatttctcccgcaaggcgcagcattcggctcccgagctcccggtcgttcccgctcatttcccgatacagctgataggattctttcgtcacatgctccgtcgttttcagcgtttttttcagatgaatcgtttcttcatataagttagacacaatcatcagcatgtgctcatgctgctttctcgtttgtttttccctgacctgagattcgtgcagcttcatcacgttgaaaaaactcagcacaataaatgtgtgagaaacagcgataaccgcaatatccgccagcttgtccggcatcataatctgcttgccgccggaaaactgaaccgtcatttcaacggcatcggacgccatttcaatgagaaaaccgagaaacccgatcatgagcggccgatcccaaaaaagcctgaccttcagcacataaaacaaacaggcatatgtaaagtaaaaaaagaaactgggatattggctgaaaaaagccgccgtaaatccggcatgctctcccccccagcacgccaggccgatccggaatcccacaacggctgcacctgtcaacagccctgacaataccgccggcacatgccgaagcagcagaagaaaaaagaaaaaagccggggcgccgaagctgatccgatatacctcattcagggggtaaaatttcagttcccccgccagcggcacggtgatcagcataagagcgaaaagatagccgtcttttttcagtaaatagtcgagcctgatcataatcacttccttcttctgtctattttgaacaagaccgatacagtccgcaaatttctttagacccgaatggcgggacactccggctgatttataaatctatcggcttattttaagaatgattttgtcgtattttgtatgattctgtagatgtcattatacattaacatggaacacgctatttttgaaaacgttttccaagaccggtttccgcttcggacaggcttgcaatagaggaggaatgttatgaaagatatggtcagagagcgccttgaaaaagaggaactggcttcacttttacaagattgggtcgagcattaccgaccgttttccgtcaatggaaaaagcgcaaattatatacccgccctcggagaaatcaacgactctcagctgggcatttgcatattagagccggatggctcaatgattcatgccggtgaatggaatgtgccgttcacattgcagagcatctcaaaagtcatcagctttattgccgcatgcatgtccagaggcattccttatgtgctcgatcgtgtggacgtggagccgacgggtgatgcgtttaattctatcatccggcttgaaatccataaacccgggaagcccttcaatccgatgatcaatgccggcgccattaccgtcgcctcgctgcttccgggtgaaacggcgcataataaattagaatatctcttttccgtttttgaaaaattaataggaaaacggcctcacattcacgaggaggtcttccgttctgaatggcagaccgcgcatcggaacagagcgctcgcctactatttaaaagaaacgaactttctcgaggcggatgtggaagaaacgcttgaagtgtatttaaagcagtgcgccatggagggtacaaccgaggacatcgctttaatcggattgatacttgcccatgacggctaccatccgatccgacgggaacaggtcattccgaaagatgtcgcgaaactcgccaaagccctgatgctgacgtgcgggatgtacaatgcgtcaggcaaatatgcggctttcgtcggcgtcccggccaaaagcggggtatccggcggcatcatggcattggttcccccaagcgccagaagagagcagccttttcataacggatgcggcatcggcatttacggtccggccattgatgaatacggcaacagcctgaccggcggcatgctgctgaaacatatcgcacaggagtgggagctcagtattttttaatcaaacgaaccaagaggtgattggatgcaggaattccttgaaaatgtaatcggctcggcaaatgattttttatggtcaaaactgttaatcgtactgcttctttctctgggactgttttttacgttcagatcaaagggtctgcaagtccgcatgctgaaggaaatgatccgggttttgaaggaaggcgcggccgcccggacaaaaaacagcatttccccgtttcaggcattttgcatcagtatggcggcgcgtgtcggaacagggaatattaccggaatcgccattgcgatcgcactcggcggtccgggcgctattttctggatgtggattatcgcagtcatcggttcggcttcaagctttgttgaaagcacgctggcccaaatttataaagtaaaagatcaaaacggattccgcggcggcccggcctattacatggaaaaaggcctgaagaaacgctggatgggcgcgctgttcgccgtattaatcacactgtcattcggggttgtttttaattccgttcaatccaatacgatcagcgtcgcctttcaaaacgcgttcggcaccagccggcttacattgggcattattttaatcttggtttttggcggcgtaatcttcggcggcgtcaaacgaattgcgaaaatggcggaatacatcgtagtcgtcttggccgttttatatatcggtgtcgctttctttgtcattctgacgaatatcacccaattgcccggcgttctgtcgctaatcgtaaaaaatgcgttcggcattgatcaggcagcgggcggcgctttaggtgcggccttgatgcaaggtgtaagacgcgggattttctcaaatgaagcgggtatgggaagcgctccgaacgcggcggcgacagctacgacgagccacccggtgaaacaggggctcattcaggcattcggcgtcctgacggatacgctcgtcatttgtacaagcacggcgcttatcattttattttcagacgcttatcaccagccgggactgagcggcatcgcgctttctcaggccgccttgagcgaccatgtcggcgcgtgggcgtcaggtttccttgccgtcttaatgcttttgttcggcttcagcgctctgatgggcaactattattacggagaaaccaatatcggatttttaagccagaacaaaaagtggctgttcatttaccgcatctgcgtgctcggaatggtactgttcggctgtatttccaaagtccagcttgtgtgggatatggctgacttgttcatgggcttaatggtggtcgtgaacttaatcgcaattttccttctgtcgaaaaaagcatttgccgctttgagcgattatgcccggcaaaagaaagccggaaaggaccccgtcttttacagagatgtgctccctgatgacgacgggatcgaatgctgggagtattcagatatcgcgaaaagcgcgaaaggcaaacatatttcctaaacaaaaggtgttcaggcagcgtcctgaacaccttttttccgccggttcattgacaaagagaatagcgtccattaccctttttatatattttcagtaaagtcagaaaggaaggcctatgaatcccattacacaaatattaaatgaatacccggttatgatcatagacggcgcgatggcaaccgagcttgagcggatgggctgtgatttacatgacgatctgtggtcggccaaaattcttttggagagacccgaactgatcaaacaggtgcatgcagaatattttgccgccggcgctgattgcgcgatcaccgccagttatcaatcgacaattgaaggatttgcagcgcgcggcatcccggaaaccgatgcgatacgtctcattcagacatctgttgaacttgccgcacaagcacgcgatgaattttgggcgcatgaagaaaaccgtttacaccggcctaaacctttggtcgccgcttctatcggaccttacggcgcgagcctcgctgacggctctgaatatcgcgggcattacggactgacggaagatgagctgatcagctttcaccgcccccggatgaaagccctcatagaatccggcgccgatcttttggcctgtgagaccattccgtccctgtcagaagcaaaagcgatcacaaggctgctggaggaattccccggcacttatgcatggatcagcttcagcgccaaagacgggcggcatatcagcgaaggcacgcctatttccgaatgcgcggccctgcttgactcctgcagccaaatcgcagcgatcggcatcaactgcacaccgatcgaatatattccgccgctgatagaagaaatcaaacgggcagcatccaaaccgattatcgcctatccgaactccggcgaacaatatgacccggtgacaaaaacctggaaaggcgcagcgtgcgaaaaccatttcggaaaaagcgcgcaaagctggtacgaaaacggcgtgagcctgatcggaggctgctgccggacgaaacccgcggacatccaagccattgccgattgggccaagaccttaaaaacaacttgactaatcggaatagtttgtatattctattcaaaaagccggttcgccggaatctcgtgccgttcgccggcatgagattttttattagaacggccctcgcagaaagttggaaaacaatgaacaacaagaacgagacgaattttcagagaagtatgaaaagcagacacctctttatgctatcactcggaggtgtgatcggaacggggctgtttttaagctctgggtataccattcatcaggcgggtccggcgggcaccattttcgcttaccttttgggcgcgggcatcgtctatcttgtcatgctttgcctcggtgaactgtcagtggccatgccggtgacgggcgcattccacacctatgcgaagacctatatcgggcccgcgacgggctttacggtcgcatggctgtactggctgacgtgggcggtggcgctgggctctgaattcacggcggccgggctcttcatgcagcgctggttcccgcatacttcagtttggatgtggagtgcggtattcgctcttttcatctttttattaaacgccttctccgtgaaattttttgctgaatcggagttttggttctcaagcattaaagtcttagccatcttactgtttattttattgggcggagcggcgatgttcggcctcgtcccgatgaaaagcggtgaggccgcacctatgctgtcgaactttacggatggcggcagcctttttccaaatggctttttcccgatactgatgacgatgctttcagtaaacttcgctttttcagggacggaattgatcggaatcgccgccggggaaagcgccgatccggaaaaaaccgttccgcgcgccattaagaccacagtctggcggctggcgcttttctttatcggaacgatttttgtgctgtcagggatgatctccatcaaggaagccggtgtgattgaaagcccgtttgtcacggtatttgacagagtcggcgtgccttatgcggccgatctgatgaatttcgtcattttaacggcgcttctgtccgcggccaattcagggctgtacgcgtcatcacgtatgctgtggtccctgtctaaagaaggggagcttcatcccgcctttgccaggctgacctctaaaggcattccttttaacgctctgatcttcagtatgatcggcggcattctgtcgttgttgtcaagcgtatttgcagcggatacagtctatcttgttctcgtctccgtctcaggatttgcggtagtggctgtgtggatgagcatcgccgcatcacaatttttgttcagaagacgatttcttaaagaagggcaccagctttcagacttgaaatacaggacgccgggatatccggccgtaccgatagcggcctttctcctatgcctcgcctcctgtatcggcatcgcttttgatccgaaccaggccatcgccctttattgcggaattgtatttatggccgtttgctacaccgcttattacttgaaaaaccggaaaagcagagcccgcgtgcaagccgtaaaatcccaataaccaaaaaaagaaccctgcggcgcaagggttcttttttcatttatacttcaacgacccatctgaacgaatcccgcaccttcccgacttggatgccggcaatcgtttcatagagcttttctgacacttcaccgatcaaaccgttattcagctcaatcgtttctccgtgaatgtgcagcgcgccgaccggcgagatgacggccgcggttcccgtaccgaatacctccgacacctcgcctctcattgcagcctcatagatgtcatcaatggcgacctgttcttccctgacacggatgccccagctttttaacagctctatcacagatgcgcgtgtgatgcccccgagaatgcttccgtttaacgccggcgttacggcctctccgtttatgatgaaaaagatattcatactgcctacctcttcggcatatttcttttccactccgtcgagccaaagcacctgatcataccccagttcttcggctttccgctgagcctgtaagctggccgcataatttccggacgttttgacgtcgcccactccgccggtgacggcgcgcacatactcatcctccacataaatacggatcggtttcagctgatcgccgtaatacgaaccgaccggcgtcaaaacaaccatgaacttgtaacgctttgaaggccggacgcctaaagaaggctcagtcgcaatcacaaacggacggatatataaagaggttcctttttctatcggtatccattcctgctccagctccaccaattgtatcaatgcttccagcgccagcttctcgtcaagaggtggcatgctcatccgccgtaacgatttattcagccgttttatattttggtcaggacggaacatcaacacccgtccgtcttctgacctgtaagccttcagcccttcaaatacggcctgcccgtaatggaaaaccgatgcggaaggatccagatggaccggttcataaggtgtgattctcggatcatgccaccctctcccctcttcgtaatccatgacaaacatgtaatctgtgaagtacttgccaaatcccaatgaagcggaatccggtttttcctttctagctgtgaccttacgtctttcaatcagttgattcaacaaaagcacacctttcttctaattgttcaaattttcagtcttttctgggctgcatgttttttctgtcccgaatcttgtatgcacagatatatgagaatgcagttgaccatatcatatcaaatataccacttataagaggataattatcaaaatttttaatattttcagcggaaatctttctttattcttatgctccttcatttttttcaatgaggactttctgtcatattcaatgattgcgcttacataatgtaaagcaatccttcctttcgcacagtcaatcatgtgacaaatttatggcggacaggaaggtggttgccgcctgcttcacgaattacgtaagaaatgcgcaagtaaaagggggattcgcttgaaaaaatttatcgcattccagattttgatcgctttagccatcggagcattgatcggccatttcttcccggatttcgggatggcgctgcggcctgtaggagacggatttatccgcctgattaaaatgattgtcgtgccgatcgtgttttcgaccattgttatcggagccgccggcagcggcagtatgaaaaaaatgggcagtctcggcatcaaaacgattatttggtttgaagtgattacgacgctcgttctggcgctcggtctgttattggcgaacgtgctgaagccgggagtcggacttaacctctctcatcttgctaaaaaagacattcacgagctttccggctatacggaaaaagtagtcgatctgaaacaaatgcttcttgatattatccccgttaacatcattgacgttatggcgaaaaatgatcttctcgccgtcatttttttcgcgattttattcggtgttgccgcagccggcatcggcaaagcctccgcacctgtcatgagtttcttcgaatccacggcaaatattatgttcaagctgacgcagatggtgatggtcaccgctccgatcggcgttctcgccctgatggccgcctccgtcgggcaattcggaatcgcgcttctgctcccgatgctgaagctgatcggcactgtgtttctcgggctgttcctgatcctcttcgttctgtttccgatcgtggggcttatctttaaaatcaagtactttgaagtgctgaaaatgatttgggatctgtttttgatcgctttctccacgacaagcacagaaaccattctgcctcagctgatggatcggatggagaaatacggctgtccgaagcgggtcgtctcctttgtggttccgtcaggtttatcgcttaactgtgacggttcaagcctctatttatcggtgtcctgtattttcctggcgcaggcgtttcatgtggagatgccgctttctcagcagcttctgatgatgcttgtgctcgtcatgacaagcaaaggcattgccgccgtcccgtcaggctcactcgtcgtgcttctggcgacagcgaatgccgtcggtctccccgcggaaggcgtcgccatcattgccggtgtcgaccgcgtcatggacatggcgcgaaccggtgtcaacgtgcccggccatgcggtcgcctgcatcgtcgtatccaaatgggaaaaagccttcacatataaaggacccgtcacggcagatcagaccgcccggacagaaagtatgtaaacacaaaaaagaccacctcattggtggtcttttctattaatcaatcgccgcatgatcctctttttcaatcaaagcaaggcgttcattgatttcttcctgagtcatttcgtgctctttcacatacatgtttcgttcgttcgtacggcattcgtgactgcagctgcgcatgtatttgtattcattctcaggtgtgcagatcatttttttattacatgccggatttgcgcagttcacataacgctcgcacggctcgcccgtgaaataatcttttccgatgataacgtgctctacgcggttgaccggtacgctgattctttcgtcaaacacatagcactgtccgtcccacagctgcccttgcacttcaggatctttaccgtaagtgacgataccgccgtcaagctgggacacgtcttcaaatccctgcttcagcagccagccggaaaatttctcacagcgtacgccgcctgtgcagtacgtgaggatttttttgccttcaagcatgtctttgtgttcttcaatccagtccggcagctcacggaacgcctcaatatcaggtctgaccgctccgcggaaatgaccgaggtcatactcatagtcgtttctggcgtcgatcacgatcgtgtcaggatcctgcatttgctcataaaagtctttcggtttcaaatgcttgcccgtcgtgacattcggatcaacatcatcttcgagacgaagcgtcaccagctcttttttatggcgcacaaacattttgcggaatgcatggccgtcagcctcgtcaattttaatcggcatgtcggcaaaacgcggatcagctttcagcgcattcatgtattgttccgtctgttcaaccgttccggacaccgtgccgttaatgccttcctcagaaatcaaaatacggcctaacagaccgagctccttacaaaacttcaaatgctgagccgtgaactcttcaggctcatcaatctttacatatttataataaagtaaaactctatattgtttttccatgatttatacaccctgttcaattatattaatgatcacgcacactatactatatcatacaggaaaacgggcgaaagatgaacatttccgtccgtactctttcttccagtcacgcttcgccttttaaaacctgctgaaaataaaaccgatacgtattgcgcaaaaaggtctcaagcgaaaggccggccgcggtctgatacttgccgataataaacggaaaacggtcacggccttttgcccgcagaagatccgcgctgtcttcagccagttctgagatgagcgcctcaacgacaggccggcatgcatcccgcaccgcttcaagaatttgctgatcgcctgtatgccgatactgttcgatcagctttcccaaatccttttcttccataaagttcacttccttacaccatataaaaaagaggagcagcttttataaagcggacgcctcctcctgtgactccgcataaccgatgatctgaccgacctgtaattcacggccttcagtcaggttatccgaaggggtaaacatatctttctcgaatactaaaataacggtcgatccaaatgaaaaatagccaagctcttcccccgtctcaagccggtttccggtgtttgtctgaacgatcgagttaatattcatcgcacctaccggaatcatgagcatctgctgatcagcacgggtcagctcgtacacataacggtaattttttgagagcacatctttcccgtactttaaccccatcgtattaacgggataggagcgtttccccagctcggccagctttttatacgtgcagctgacgggagaatggaagcggtggtaatgtctcgggctcaggtaaagcacggcaaaacacccgccgttatacttgtgatcggcgcttttaaaccccgtcagttcggcgaacgaataatccttcccttttaccatgaaagtttgattgggattaatcatgcccaccgtctgaacgacgccgtccaccgggctgacgatggcgttcttctcttttgccacggggcggagattcaaattaatatcacgaatgaaaaatgacgccagtgaatcaaagtcagaagccgtgcgttccgtttcattccagttaatgcgatagtgtttggaaaacagcggaatcatcggcttgctcagtttcgattcacagaagtttttaatgagataagacgtcaatcgattattagtcagttcaatcaatgaacggtaaagaactttagcggcagtattaaacattgattactcctatgaattttcctatagtaataaaaataaaacaccataaaaacgctccgatggcggcgaagcataagtaggttttgaattccattctgccgattccggaaaagtagcaggtcacgtgtctgatgccggggatgaaataacctaaaataatggtgtacggcccgtacttcttcatccacctgtctactttctccatcctcttttccttcaggccgacccatttcccgaacttattaataaacggccggccggcttttctgccgatgaagtagctgataatcatcccaaggagcgctccgataaagctgatcagaatggagagcccgtaattcagcacgtttaaatgagcgaagtagcccacaagcgtcatcatgacttcatccggaataggcaatccgataataccgagtgtcagcataagaaaaatcgcgatatatccgtaatcggatattaattgctgaactaattccatcttctgctctccaggttttcaggcgcctgttttttaaagtgcggaaatttaatgttgctgaccattaaataaccgagcgcgatcgttcccgcccccagaagaaaagcgttattgataaagctcaaaatgacaagacacatacccgcaaacggaatcggcatcccgataaacgtcggcagcttgctttgttcaatattaaatctggaaagacggatcatcccgcagatgctgtaggaaagcgcgattaaaattccgatgaacggaagcgtatatagtgaaacactgtaagcgagcatggacggcgctacgccgaacgtcacgagatcagcaaaagagtcaagctcccttcccatctccgataccgcgttcagcttacgggcggccaaaccgtcaaagaaatcaagaaacatcccggtgaaaataaagatcaccgcagagtgtatattatgatacaaaagggaatgaatcgataagagcccgcaaataaaatttccaattgtaatcatactaggtatataattcacagtttacacaaacctccaattaaaaccatatcaaatcggactgcgtatgcataaagactccattttacggaaacataaaatgaaatcctttcaatgctatcattcaaattcttttattatacagcatttggtgttatttgaacaatctaatctggtgatttttgttttttcgccgttcatattaaggtaagcaatcatggtttcctctattccggattaccctgcttaaatattccatgctgcgatccggattgtccgttcttgatgaatgaaaagccgtatgatgtattgttatttccttctccgtgaaatgagaacattacatataacgattgcggacataaaaagtttcaagaattaaaaaaccggcacaaaacggcctcatacattatctcacaaccccgttttccagtatatagtctgtccaaacaaaaaaggcgccttaccattacggtaaaaacgccttttaagatcattttatgtaattgataaatgactgagtgcttcggccgctctttctctggcctcttcaacggtctcggctgcagaaagcgcaaccgccatacggcgtccgactttcgtgacgggtttaccgaatacgcggacctgagtgctttttaccgccaaagctttctccaaaccttcaaccgcataatcagcaagctctttgggcgccttcagcggacggcttgcccccggcgacagctgaatgatttccggaatcgggaatcccaagaccgcgcggacatgcagcgcaaactctgacaaattttgcgtcacaagcgttacgagccccgtatcatgcggacggggagacacctcgctgaaatatactttatcttcagtaaggaaaagctccaccccgaacaaaccgtatccgccgagctcatccgttatgcttttcgcaatgtgtttcgcctcttcaatctgctgttccgtcatatgatgaggctgccatgattcaatatagtcaccgtctttttgttcatgtccgatcggcgcgcaaaaggacgtaccgttcgccgcgcgcactgtcagaagagtgatttctgattcaaacggaatgaattcctcaacgatgacccggccgtttttcacccggccgccttccattgccatgtcccagcagcttttcagcccggaagccgagcggcacacgctttgcccttttccggaagagctcatcagcggctttaccacgcacggaaagccgattgtttccgccgcttctttaaattcttcgtatgtattcgcgaattcatagccggcagtcggaagatgaagcgtctctgctgcaagccgtctgatgccttcacggtccatcgtcagctttgccgcacgcgcattcggaatgacgtgaaacccttcttcctcgagcttcagcagctcatccgtcgcaatggcttccacttccggcacgattaagtccggtttttctttctcaatgacttctctgacctgcgctttatcaagcatatcaatcacatagcttttgtgtgcggcctgcatggcgggagcatgctcatagctgtcaacggctacagtgacaaccccgagccgctgcgcttcaatgacgacttctttccccagctcgcctgatcctaataacaacatcttcttcgcctgatacatgtcctttggcccctccctttctataccccactcattataacggaaatattcaaaaaataaagacaagacagattacaagctctatcctgtcttttgtgctgattcgagcgattcaatcgccgctgacacgtccttcccgcaatattgccccattaagcataacgattcttccgcccggcaggcgtgagaagcgatgcggcgctttgcttcctcatggttgtcaaggatgccgagagcacagagactgacggggaaaccgagccggcggtaaaacggaagcagctcttcaatctcatgtctccgattctcaagcgcgagctgcaccaatatgccgtaagcaaccttctggccgtgcagcacctgatgtgtctcctgaagaaaactgaggccgttgtggaccgcatgcgcccctgccatcctgcacaaacggccgccatacccgccgaccgttctcgcaagcataatgatcgtttccgccgtatggatgaacggcacggacagctcgcctttctccatgcttacgacggcggcttcactgtaacgcaataacagattacgcatatattccgcctgtctcagccccgcctgcgccatcagaggcggcgcttcctccgtatttctgatgaccgcctcggcctcataccatttcgccagcgtatcaccgatcccgcttttcatatattcaatgggagaggaaagcaaaaacagcggatcaacaagcgtcaaatagcttgaacgcttgtgataatcaactctgataaaattgccgctctcatcatatatgacactcaacggcgtacttgccgcacacgtccccgcaatggaaggaagcatcacagcctcaatatcaagccggtctgccgccgcttttgccaaatccaaaatcgtgccgcctccgataccgatgatcacatccgcgtcttccgcctgcccgcagaccttacgcaccgcctcaggtgaacagtatcctttgtgctgaatcacatcccaggaagaaccgccgccgtaatcggagaacgcctgataggatttgattccggtcacaataacgggttttctgaatgtctccagcagccccggaagttcttttgcgattccttccttgcatatgtactgattcgggccgcttcggacgatatcttcaggcttcattcgaatctctcctttggctggaatttatacatattttctcacttgtcagaaaatacatcaaccggaggtgcgtcagcgcttcgcttcctccgcctccaaaaacagctcatcaagccgctccaaagcttctgccttttcaaaactgctgaaccacagatcatcataagaatcaaggatgcggtaatgatgggaaatcaaatgctgctgcaagcggaactcgccttttttctcgatggctttccaccacaccttgccgcccatcgtcttccccttcggcctgtcaattgtgcggtgagcaaccgtttcaatgacctccagcggatcatctcctaatacggattgcagtgtttcacttgatctgaaaagcgcgcaaaccgccacaacgtgcggccattccgcaagcgcccgccctttctcaatctgcaccagcgactttttagaaaggccgatcacatccgccattttctcctgtgtgtagcctctctccgaccggattttcttcagctggactgagacaagctcagtcatataatcttgatccatctcaacctccatttttatcaatatagccattttacaccgcggcacgccttttttatatcagaacattttcaaacaaatcaaaaggacccgggatcggcttttcattgaaacgatgtacctttccgcataatccagaatgatgcggtgaatacaaacgtacgcccgaagagacagatgcggtctccctggcggttgagctccggagaaaataaaaagctgccgcagctgcggcagctaaaacattataagctgaaaatcaaaattatgaagcgaatacaatccaactcgcactataattgacacgttttttcgaaccttgattgaccattttaaatctgtatgaatctcctttttttaacaaaggtgtttcaaaataagtcgttccatttttctttgcattggcggttttgattgttttccaggcacctttgccgttgacttgcttttgaacgtatattttatacgtgcccttccctttactgttggatttaaaagtcacggctctcaagctgtacttttttgtcgtcttagtgaatttaggatgatatgtattgatcacatagttagtgaaatacccgcttttataagtatgaagccagtctttagcctctgctttttgcggagaagaaaaacccataaaaccaattccgctgattaaaagagtaaaaataatgatgagcgacttaaaaatctttttgcttttcatcgagaaaatccttccttcctgtaactatttaccctatttatgttaatgacaatatagctaatcataaatccgtccaactaaccattttgactgcagggagagatgaaaacagccctgaaaatgactatatgactactacttatgattcttgttatttttgattaagtgataaagttactttaaagcgctatccattttgctgtttttgtatcaattgtcatagagagatcttttcctatcaatgcctctctatcggcgtttgtatgatggggctgtcctcggacaaactcctgcacccatgacaaactgtcatacgtttgccacctatgaatgaacgcacactacacgtaatggagggattgcaatggacgaaatggtcctggaaacacaacaatggctgaatgagacgtacaaaggcagacacgggtacaacaaggtgccggaaaacggaaaaacaggctgggataccatttacggtctgacacgggcgcttcaaattgagcttggtatttcagaaccagccgataacttcggaccgacgacacaaagattgtttaaaccgttgaaaaagcaggctcccgattctaagccgacaaacatgaattacattctgcagggggcgctgtggtgtaaagggtttaacccgggcggattttctggcgttttctatgaaaataccgaaagcgctgtaaaagagtttcaaaaagcggccggacttactaagcaagacggcattgtcacggcactcattatgaaggctttgctggatatgagcgcttttcggttagtagcgggaggcgacaaaagaatccgccaaatccagcagaacctgaaccgggattacaatgactacatcggcttgatgccttgtgacggcttatatgcccgcgatacaaacaaggccctcatctatgctctgcaaaaagaagaaggcatgagcacaagcgtcgccaatggatttttcgggaacggaacgaccagcttatgtcctaccttgactcccggcgattcacggacaggctttgttttgattgttcaatacgcgctttactgtaatgggaaatcatttgaccccggtgaattcgacggaaaatacggcgtcggagttgtatcggcagtgaaagctttccaagaatttatgtgcctgccgcagacaggttatgcggacatgccgacgattaaagctttattatcaagctcaggcgacacaacgcgggctgcttcagcttgtgacaccgctgccattttgacggcagatacggctaaaactttgcgtgagaatggctataagatcgtgggaagatatctgaccgggaatgtgcggactagcagcggactgacatcgaaagcgttaacgtcaaaagaactttccgcgattttcaatgccggcttaagcgtgtttccgatttatcaggacggcggctatgaatcttcttattttgtaaaagaccaaggaacgagagatgcgtacagcgctgcatcagccgcccgaagattaggttttccgtcaggaacgaccatttactttgccgtcgattttgatgcgtatgattatgaagtcacggataaaatcatcccttacttccaagaaatcaagtcagcttttatgaaaatgcaggcgttctcaactgcgccgaaatatgaaatcggggtatacgggccgagaaacatttgtatccggacgtcagaagcaggtctgaccaaatatagctttacggctaacatgtcgaccggattcagcggcaacctcggatacccgatgccgaaaaactgggcttttgatcaattttatgaaggcacgatcggaagcggagcgggaaaagtcgccattgacaaagacggatactccggaaaagactcgggtgcaagcagcgtccatccgccttctgatcccgtgtatgatgcaagactgcgcacactgacggacattttaacaaccattcctgctttagaaaatatatcgaatcttgcgaatgccatgtttgaattcgacaagacagaaaccatttatgcatcacctgaaatggatattcttttatctacttcacttttggcaacagtgccaagcgaaggttctcccaacacagttaccattacaaatggcaaaccgggagcttatattaccggtctgatgggagattcacaagtctcttttacagcatcacaaattgattcgtatcaaaacctgcttaacagtctgagcttgtcagtgcgcaacggttatttagaagtgtatgtcaatccggctgcgggatcgctgaatattcaatttaaaatttatacacctgatattccggtcggtgacagtgctactactggactaacaactaccattacatttaaaataaaacaaaagagcttcagattgccggattccgaagaggtgtactctccggattgggattctgtcgtgaataccatggctattgcaggcgcaggaattattgttattgtagggatcggtgctttagtcgttttagcacctgaattaggaggagctgcagccttgttcagcacagttttatcactatttctataattgaacaggcagctccttgctccaggaatgctcaatgagtattcttggagttattttttaaggaggattcgtatgaagattgatatgcagacatacaaggacaccgttcaaaaaatagaaaatgatttgattccgcgaagtcaaaatgacaaagaactgcttacatatttaatgaaacaagattcgctcacactgaatcaaatgaaaatgtgtttcactgaaccgctcctcaccttccaacatactgtcaaaatcgtatgtacagtcacattcatcacgttatatatcttttttttcagcactcattttaatgatttgattgaaatggctctgcagatggtttttggcctggccggccttgtttggatttttgctgtatttccgttttcaaggaaaatccaagtgtctgaccgtttcagacaaaaatctgaaaacacccgtatcaccggaatgatagactttgtcctcgaacaacgatacaaagacatgatcagttaaaaacccctctgcttaaggggtttttttatgatgcaatcccttcaccccccttatcaaaaaaggctcttcccctttggaaataaccggaacacccaatttcgttttcaatataatgaggtagtggatctgcaaagaaagaagggcgacatgatgggtatcattaatggcaaaatgttcattgaccgattaaatcagctaggaaatgagatttggcttgatggtgaaaagatcgagggacagatttctgaacatcccgcatttaagggccttctggaaacgaagcgctctctttatgatttgcaaacgaaaccggacatgaaagatcaaatgacttacagtcttcccggtaaaaaagaacgggccgggctttcatacctgcagccgaaaacgaaagaagacgtaaaaagaagaagaaacatgttcgaacattgggccagacacacgcacggaatgatgggacgaagcccggattatatgaataccgtgctgatgagcttcgcctcctctgccgcgcttttgaaagaccgtgatcaatgttttccggaacatgttcaagcgctgtacgaacgcgctgccgcacaggatctttcttttacgcacacgtttatcacccctcaggtgaatcgttcacaaatgggtgtaaacgtatcgccgacacctatctcggcaaaagtcgtcgataaaaatgaaaaaggccttatcatacacggcgcgcggattttagccacacaaggcggcctgacggatgaagtgctcgtggtttctctgcctaagatgtattttgaatcggatgaagcgttcgctttttcaatcccttccaatacaaaaggagtaaaattcatctgcagggaatctttcgtactcggaaaatcatcgtttgattatccgctcagctcaagatatgaagaaatggattctatcgttgtatttgatcacgttttggtcccttgggaacgcgtatttttttataataattacgaggcggcttttgattttaatatgaaaagctcttttaacgccttcgcatttcatcaagttatcacgagacaaattgtaaagacggagtttctcctgggcctcgcccaaacgcttgtcgatgcgatagatgtgggggaatatcagcatattcaggccaagatggctgagatcatcaccggtctggaaacgatgaaagcccttttggaaaagtcggagaatgatgcggaaacagacgaatggggttatatgcgtccgagtgtcactccgcttcgcgtggtcagcgcgattttccctgacatctacccgcgcttcacggaaatcatccagctgatcggggcaagcggaatggtgactttgccgactgaaaaagcgttccgttccgacatcagaggagaccttgaccaatatttacaggcggccgaattgaacgctgaggaccgggtaaaagtgttccgcctcgcatgggatttgaccatgagcccctttggaacaagacagacacaatatgagcggtacttcttcggtgaccccgtccgcttagccagccatctgtacagaagctatccgaaagaagaacagaccgcggtcatcaaggaattcctgcacattcataaataaaacaaagcagagaacgcatctctgcttttgatagctggatcggctgccgccgatcctattttttgttttggctgatcaccaccatcgtaatatgcgataacgcgaaagagacgagcgtgtacacgacggcccacccgataaacgagaaattcaatatggtaaaggtgcatataaggcaaacggctaaagcggcagccggcataatgaacgcgtttttaaacaggtacgttccggcgactgacaggatgatgatacaaagcggcagaacaccgaacgcaaaatccaattcatcaatcaacagatgcactcccttcgcttttcttagttcggcctaacacatcttatgcctgagtacaaaatcgagtacatcaaatctttcgcgctccggctgatattccctccggttatttattcaaaaaaatgaaaactttccttaaagcgtttacattcacgccagactgtgataatttaagaaagcgctatcatatacaagttaatgatttttggatggagatgaggagaaccaggaaaccgcgccctttcataagggtgatttctggttctttttgtcattttcaaggaaaggagtcatacatacatcatgatagacgttcagcaaaggggaggatatgatgtttcaattgttcaagccggctccgcatattgagagattggatgattcaaagacggatgcggcctataaacggctcaggctgcaggtatttttggggattttcatcgggtatgccgggtattatttacttcgcaaaaactttgccttcgctattccttattttcaggaacaagggttttcaaaaggggaacttggcttggtgcttgcggccgtatcaatcgcttacggcttcagcaaatttattatggggatggtgtctgaccgctgcaacccgaggtatttccttgcgacaggtctgtttttgtcaggtgtcgtcaacattttatttgtttccatgccatgggtcacgtcaagcgtgacgattatgtttatttttatgtttattaacggatggtttcaagggatgggctggccgccttgcggacggacgatggctcattggttttccatcagtgaacgcggaacgaaaatgtcgatatggaatgtcgcccataacataggcggaggtattctcgccccgctcgtgactctcggcatcgccatgtttgttacttggaaaagcgtatttttctttccggcgattatcgccatcgtcatttcatttgtgattgttcttctcgttcgggacacgccgcaatcctgcgggcttccgccgattgaagaataccggaatgactatccgaaacatgcgttcaaagaccaggaaaaagagatgacgaccaaagaaattcttttcaaatacgtgctgaataataaatttctgtggtatatcgcatttgccaatgtctttgtttatttcgtgcggtacggtgtcgttgactgggcgccgacttatttgacggaagcgaaagggttctctcctgaagattccagatggtcttatttcctttatgaatatgcgggaattccgggaacgattttgtgcggctggatcagcgaccgatttttcaaaagccgccgcgcaccggccggcgtgctgttcatggccggcgtatttatcgctgtattggtctactggcttaaccctgccggtcatccgctcatcgataatatcgcgctgatcagcatcggattcttaatctatgggcctgtcatgctgatcggacttcaggccattgaccttgcgcctaaaaaagcggcgggaacggcagccggcttaaccgggtttttcggctacatcggaggctctgctttcgccaacgccatcatgggttatgtcgtagaccgctttgactggaacggcggctttatcatgcttatctcctcatgcgtgctgtccatcgtcttcttggctatgacgtggaatacaggcaagcgggcggagcatgtgtaagaaaacaacataaaagattaatatttttgcagtacagcatttacaacgattttctacactagagacagatattgatttttaagggggaagaaaacatgcggaaacataagttgtttgctttggtattgctttcattcggtttattgtcattcatcgtcacgcctgtatcggcggcgggaaaaggaaacctcttgtctcctgacagaattttaaccattgcccatcgcggtgcttcggggtatgtcccggagcacacgatcctttcttatgaaactgcgcaaaaaatgaaggctgactatattgagctggatttacaaatgacaaaagacggcaagctgatcgtcatgcatgatgaaaaactggaccgcaccacaaacggacaaggctgggtgaaggatcatacattagcagagattcaaaagctcgacgccggttcttggttcaataaggcctatccggaaaaagcaaaaccgcaatacgccggacttcgcgttcccacacttgatgacgtgttaaaacggttcggcagacatgcaaactattatattgaaacaaaggcgcccgaaacatatccgggtatggaagaaaaactgatcgcctcactgaaaaaatacaaattggcaggtaagcatgcgaaacttggacaagttatcattcagtctttcagcagggagagccttctgaaaatcaaacagctcgatccgaaacttcccgccgtccaattgcttgaagcggaacagatgacctcaatgactgacgcagatttaacagacatcaaaacatatgccgtcggaatcggaccggattacaaagcgctgaacgctcaaaatgtccgaaacattcgcagccacggcctactgcttcacccttacaccgtgaacagcgagacggacatgcgccgtctgctgaattggggcgtaaccggtgtgttcaccaactatgcggatatatttcaaaaggttaaaaaagaatataaatcataaagccagcatgggttcggagatgatgccgaacccatgtttttttgcctgatcaaaaaaccttgcgggaacgttaccgcaaggtttttatcaatcattattcttttccggcagcggcttccgcctgcccgccttttaattgatcgttgattgctttggcgtctttcaaatactcagtcttgaatccgctcttcagcgcccacgcatagaaggcaagggcaacgattgcgatcagccccatatcccatccgtacggaatgatgttcagaccgccgaatttttcacttccgagccatgaaatgaccatcatgctgagcagatagacaaccatccaaacgccgcctttaaagtttctgcggaatcctttccacttcgctttcgcttggtagtagaaataaatcggaaggccgatcaaaatgataaacagcacctgccctgttaacggccagcgcgcccaatacagcacgagagacgcgaacacgaagccgagcggtgcaaccacgctgagtcctttcagacggagaggcctgtacaaatccgccgccgtcctccgcagcgtcattaccgtcacgggacccgtgatataagaaatcagcgtcgctacggaaatgatttcagcaagcacgccccatcctctgaataaaaacagaaagataaacgatacgatcaggttgaaaatcatcgcttggcgcggcacgccgtacagcggatgaagctttccgaaaatgctcggcatatatttatttttttccatgccgtaaatcatgcgtgacgtcgtagcggtatatgtgatacccgttcccgacggagatacgaacgcatccgcataaagaataatgacaagccagttgatattcaatgcgatcgccaaatcggcaaatggagagttaaagttcaggtgactccagccgtgaacgatcatggaaggttcaaccgcaccgataaatgcgatttgcaataggacgtaaatgacggttgcgaccagcagcgaaccgacaaccgcaatcggaatcgatttgccgggattttttgcttctccggccatgttaatcgggctttgaaacccgttaaacgcaaatacgatacctgatgtggccaccgccgtcagcacgctcgcccagccgttcggcgcaatgcttgaaccggatgtgaagtttccgccgtgaaaaccggtaaacagcagcgctccgattgtcagccccggaataataattttaaagatggtaatcaatgaattcgcttttgaaaacaagttaactgtccaataattcagtaaaaagtaaataatcagcaatacggatgcgaagccgagcccctctcccgtaagtgtgccgttgtgaacgagattgcttgtccactttgcccagtcccacggccatgagctcatatattgaacagacgcaaccgcctccaccggaataacggaaacaatcgcaatccagtttgcccatcctgcgataaatccaataaatgatccatgagaatattgagtatattttaccattcccccggcttccgggaacattgaacccagttcactgtaagaaagtgcgataaacaaaattacgatcataccgataatccaggaaataattgcggcaggtcccgcaatctgagccgcccgccacgccccgaataaccaaccggagccaatcatcgacccaagtccgaccatcatgagtgcaaacgttcccattctgcgatgtaattgattcataaagttaacacctttcaattaaaatatgactccagcgctatcatatatttataatattattctgaaaatagttttgtcaatctttatcgcattaaagcggcaagccaaaattaaccttccgatgtttaaacagccgttaagcgggaataactactgcaagccataaatagaaaggagtttttatcgtgaaacaaaaactgctcatttcaggacttgccgtgtcgactgtcggagtgacttcctacctgctcaaagataaatcaaaccgccaaaaggtgatgaactttatccgcaatatgaaaacatcgctctccgggaagcaggatattgaatcattccccgtcaacaaagcaggcaacccgcatcccgaagatattgaagataacaaaatggtatccgaaggctccatgtacccggttcaatattatgatgacaagaagaaataatctgtgcccgggctgcccggccgtatcaaacggcggcagctttttttatgcagacggcgttttatagatccgccaatattggcgcgatcctttctcccgcacggtaatgcccagtttggatatttccgctttcagctctttcgcatcagccttttcctcctctttcagcgccttttctctcgcttttaaaagagcatttgccccgggctccaaatccggcgtgtccggcacccaccgtttgtattcttctttaaaaggatcttccgtccccagccagacatacccatgcgcgcgaaacgcatcagccgctttttcaaccgccggctcaagcttctcccgaaaaagctcctgtccttcagtgcctaataaaacaagatacttcccatccgtaaacacaccggaaatgctgtctttcgaaaacacgctttcttcattatatatggttaaggacaccccgctgtccgtcacgactgccacaagactttctttaaaagctgcccgcgtcagccacactcccccaattaagccgataacggcggttgcagccgcagccttccatccgtgaaaggaagcgattatttccagcggcccgtgaaaaggcagccaatccaatgttacggcccacttcgtaatgaccggcagaaaccatccgatgaccagccccaataatggcggcaccagataaaccaaagctttttcaaccgatgacaactcaagaaccgtctgtttttttatttcgttcatgtttctcctccgtctgtgtttttcacaactatccattatacaaagggttggatgattctgtaaactggttccgaaacaataaaaagcctcccggccgccgggaggctctttaaaatagaagctcatatacttcattcaattccatcgtgcgcttctcatcctgctcgttctcagcatatttgatttccttttcaagcacctgattcagcgcatccatttccagatcatttagatctttcacgaactcgccctcatttgcataatgcttcacctgaagctttttataaaccccccggcacacatcatgctccaagtggttcgaaagcgactcgcgcaaatatccgagtgtcctgtccatcatgtaagccctcccttttctttaggaatagcttcccggaaagagagaaaaactatacatgaaagcaccgggcggctgttttaactctgtacctgaatggagaaaaatccgctgcttaacggcgtgtacggcccgttcagccccgttgcggagaaagagaacgttcctgaactgacataagaaagaggaacgctgtaatatttaatatagcctgtaacgatattgccgtttttcgtatattcatcttccagcgcttttgacgtaagatttgtaatattcgttccgttgttaaacgcctggatcgtattattgttcggatacccttggaaatatacggctaaataacccgttgtccccttcatcggttttgatgcgctgatttggttcggaccgatattttcccattggtaattctgaccgtcagacgtcacaccgataatacggatttgtgttaaagcaggagccggcgccgcagacgctgacggaacccacaacccgctcacaagcaacaaagcagcggcggccgcggcaaatagcataacgagtctctttttcatgtttcttcctccttgtggttcaaatttataattatgttaaatattataagtttcattttatcagagaaatcaatagatagacagaatcaatcagtcaaattggtgaactttttatataaaaaagctatctcctaaaggagatagcttatataacattatttctttccacactccaaaattgtgtatttactcggagtctgaattacatttaatagtgttaatccggctttttcaatcaattgttcaaactcggttatctttctgactctgccgcctgcagagcatactaaaaataataaatcacgaaaagcttcttcaggggacagcctgtctgcttcaggcacattttcaactataatcagcttggaatgatcagacatggcaccggctatattttcaagaatagcaaccacatgctcatcatcccaatcgtttaacactttgcttatcacatacaagtctccgccggaaggaatttcctcaaacatactcccttccgtaaactgacagcgttcgctcatctctgaagatgctaaatgcttttttgcactttgtatcgtttttggaagatcaaacaatatcccctttgatttaggagccacacctaaaatgcctgttattaactggcccattcctcccgcgacgtctacgataacatcaaacttttcaaatgagtaagctttcaatatggatggcagactcatttttgaataaatctccatcgccttatccattgtttttaagtaatcttgatcaagactattattctcataccatttatcaccataaatggcttcaaaagcggatttgccggttttgatactataatccattttaaacatagactgcactactgtttcatgcagcagatattctaccaaaggctcaatggattttgctttcccaggcatcaaagtggcaccatactctgttacatcataatagccattttgagcttgggcgaccaaaccgacggattccagcgctcttaagagcctgaataaggcagaggggttcaattcaagggcttcagctatcgcttccgctgaagctggtccattttgaaaggcggaaaatacatccaattctaccgctgttttaactgccagggaaaaccccagccctgaaaccatttgcatgactgcggcctgaggatatttcttcggtacttgtttatcttgctgaactgaattggtcatttacgttaacctccgattaattaaatggtttctgctgcttttttgatataacgcatatactgattgagcagattttctacagtactcttatagtactgattttgattatattcaattccaatgctcaattttttctctcttaccaacacaataaacttaaacttgtaattccaaatttcatcttcacttatatcattcccggttgaaagcggagataccgtaaagctttctgtgtgcagttcattatcaaattcgcccatataattaaatgaaatgtctggttttgatttctcttttatatcttgttttaaatatcttaaaataccatatcctatcccttgatcaggaatattggctaaggtcgagttaacattatctaaactcgaaccgatatgatcagaatcggagacctccaaagccaccggatagattgcagaaaatctgcctactgttctgtagatattaagcttctcactctgatgagtgcggccatggttgcctaagtgcacgagagatgtattactgcctgtttgatgttttactgtcaaacctaaagctgtgagcaaaacagtctcaatagtgaaatgatcttgtccttgaatcgcattcattatattttcagtttcccgaacattaaactgcctgtacacttgtctgttatctttgactttggcaatttgcccctgaatatcaaccggaatagacggagcataaacattttcgattttcgtccaatactctttctcaaacaacagccgttcactttcagcatatttatagagataatcagaccattttaaatacgaatcggttttatttggtaatacaatgtcttcgttacttttaacttgctgatatgctgtattaaaatcttcaagcagtattctccaagacatatgatcaatgatcatttggtgaatgacgattaacagatgttccccatctgcttccttaatgagtgccaatttaacaagcgggccgtgagtcagatccatactggcttgtatttgatttattttcatttttaaaactgattgcggcatgtttattgcattgatcagatgaaagtcaaacaagtcgccgtccgtcaggcctctgattacctgtaccattctatcgcctttacgtttgaatactgttctcagactgtcatgatgctgaataatccgggtgaaaatgtcttttacaatatcttcgccaaacccggcttccctgtataacataaaagaaagattccgatggtgcagagtatcattatggctttcagccagccagcattgaattggcacaagacgggcttctcccgttatcacactgttatcagatgccgctgttatataactgactttattcgaaactccttcgattgtctggtaatgaaagatgtctttcacttccagcctaagattgaatttttccattctgaccgctgcttgtatggctttaattgaatctccgcctaaaacgaaaaagttatcttttatactgattttagaaacttcaagaatgtcggaccaaacctcactgacgattcgttcaatctcgtttctcggagcaataaagtgatgcagctcggcattattttcagctggaagcggcaaacgttttacatcagtcttcccattgttcgtcaacggaattttatctatgccaataatgactgtcgggatcatatattccggcagatattccaataagtattcttttagctgagaaggcggctgcgtatctttacatactgtataggcatatatctgatcattgtgagcaatcgcaaccgcttcttgaacattgcggtgagacagcagtctgtttataatctcatccagttcaattctaaatcctctgatttttacttgtcggtcgattcttccggcaaattctatattcccatcctcattccacttgcctaaatctccggttttatacattttctcaccagaatgaacaagatccgggataaatttagccttggttagttcttcacgattgcaatagcctcgtccaactccttcccctccgatgtataactctccgataactcccggcggcacaggcttctgctgtttatctagtatgtagatagaacagttttttatcggtgtgccgatagggattctctttatattggaaatattatcctggtttatcgtataagctgcagcatcaacacagcattccgtcggtccatatacatttgttatataaggacggtcattctttttaaatactttatagaaacgctttacttcttcaggtttaagcacttcgccgcctataataaaatgttttacacctatacggccacactgcggagactcagagagcaggctgagataggctggtgttccatcagaaatagttattttattttggatatagaattcagcaagtttcgtgatatcatgcctggcttcttcagagacgatgtaaagagagtgtcctaaaagcagtgcagaaaaaatctgtttgacagaagcgtcaaaagaaaagggtgccaacaacgctacattctgctgcccgccatgtttgcagtagatacgttcatgcagggcttctgttaaattcgctatacttttatgttcgatcatcacaccttttgggtgtcccgttgatccagaagtgtagatgatataggcaaggctatgcccttccgttcctcctttaacattcctcccgtcgtctggaactgtttccaattcattcagacaaacactttctactccgtacctttgaccatgattgttgcgatccgtcagtaacaaacgggccccgctgtctttgagcatatactcaactctttcttgcggatatgatggatcaattggcagataagctgctcctgcttttaaaattcccattattccgatgataaaatcagtggttcggtctgcagctatgcctactgcttcattctttttgacacctttttgaatgagtgctcttccaagccggtttgcatttttgttcagctcactataagttaagcttccgtcttgtgcagacacagctatttgattcggcgttgcttccgcctgcttctcaaaaagctcacagatagatgcatctgtgcctctgcttctcagtgatcttccactgtaactcaatatttcgcgtcgttcattttcttctaaaatgttaatctccccgattagtccatcttgactttcaacaatatgattgaggatcattaagaatcgctgtgagaatttttctacagttgtgcgcttaaacaagtttgatgaataagtgaactcaaacttgatatcctcttttgaaggaaatgcttgaagcagaagatcaaatttggctgttttgttttcataaagatacggcttatatttcagcccatttacttcaattgccggattatccatcagctgaaggacaaacataacgttgaaaagagcattctggtttatatccctctcaaggttcaaatggtctacaagctcttcaaaaggataatcttgattttcataagctagaagcgcattatccctaacggcttcaagcagttctttgaatgttttgtcggcagatggtttatttctcagtgccagcgtatttacaaacattcctatcatgttttctaattctttatgctttcttccggctacaggtgtgccgataataatatcttcttgaccagtaagtttatggagaagcacattaaatgaagccattaaagtcatgaaaagggtgactttttgttttgcgtttaattctgttaacttggcagtcagctctcttcctgcataaaaatagattcgttcaccttgatcatctcgttcggcttctcttgaaaaatctgcgggcagattgagaacgggaatttctcctttaaactcatttaaccaaaaatctttttgttttttcatttcttcagtatgaaataattcattttgccatatcgcaaaatccttaaattgaatgttcaatgacggcagttcgttgccttcgtataaatttatcaattccctttggaagatcgggatagacgccccatccgctataatatgctgtaaatctatcattaaaagatgtttttgatgactaatctcggctaatcctgcacgcagtaaaggagccttttctacatcaaacgggcggacaaaattagacataaggctctctaattcttcttcggaggtcttgattctatccattttaaatcggacgtctttttctatgatttgcacaagctgcccgtcccttaaacctatggacgttcttaaaacctcatgcctgattattaattttttaaacgcatcttctaaacgtttatcgtccaactctccttcaatcattaaaaagaacgggatattataagaagtgctgtttttatttaattgatctagaataaaaattcttttctgtgcagatgaggcctcataccactctaaatcgcctgctttgggaatcacattcacatcatttgtcttcctcagagaatattcatccaaataagctgagaagagttttatattcgaatgctttagcaagtctgaaactgaaagctccgttccttgctgtttattgataaagttgatgatttctattgctatgattgaatctccgcccatttcataaaaatcggatgtaacatcgatcggattgattccaagggcatttccccaaatttgtcctgccattagctctgtttctgaataacagccgtcttccctgccactcagtcttattatttgaggcttgttgactgaagggttatctggtgcattgcttatcggtaatttttcaggcagtttcacccaatgtctctcccgcaaaaatgcgtaacccggcaagctgatttttcttcttttttctccttcatataacatttcccaatcgatctctgcacctttttcatagagcttgcttatatcaatcagaagactctcatctgttctcccgcctgcattataagccttaagtttttttccagcagcggtacttagatctctatcggtcttataagaaaatgcagcttcttcttgctgaaccggcgcttcgagcagactttcaagtttttccttcagatcttcgatgtcttttacgagaaaacacactctattctccagatgttttcttcccgtattcgctgtataacaaagatcagagagattcaaattgttttcttccgagataaaatgaagatactttgatgctatatcattcaggacggacttattttttgcagacagagtgaatacctcttttacctgtctctgttcagtctcacctattatttcaggtgcttcttccaatacaatatgacagttggttccgctgaagccaaacgaacttacaccggctcttcttggcgtctctcctttttcccaatttcttatcatgtcattcacataaacaggtgaattcgaaaaattaattaaaggattcggttcattaaagttgatacttggggggatgaccttctcttttaaagccatgcatgctttaatgagagacgccatgcctgatgccccgactgtatggccgatattgggtttgactgaacctataccgcaaaactgctttttatcggtatatttcttaaacgcattcgttatccctttgatctcaatggggtctcccaaaatcgtgcctgttccatgtgtttcaatataagaaatagtttccggactaatattcgcattcttccaggcacgtgaaatcaatttctcttgtgattcagcattaggagcagtgattccgttagaagccccgtcattattcgtagcgctccctttaatgacagcatatatgtggtctctgtcttctatagccctatgtaaaggttttaatacaatagcagaaatcccctcaccccatgcggtcccctttgcatttttatcaaaaatgctgattttagcgttttccgcttctatttcgctcatcgtacctatattttcaggtctcagaaataaattaacgcctcccgcaatagccatgctgcattcttcatttttaagtgcctcacaagcaagatgaaccgaaacgagtccggaagagcaggctgtatcaacaaccaagcttggccctttcagattaaaaatgtaggaggtcctgcttgccaatatgccgggataagtacctgtcattgcaatcatatccgcatcctttactagggaagcataggaaaacttcaagtcaccgctatgatcatgtccaacgaaaatacctgtattcgaaccttgtaacttgttccccgcataaccggagtcctcaatagcgtgataaactgtctccaaaaacaatctttgtttcggatccataagcatggcttctcttggcgaaattctgaaaaatgatgaatcaaacttatcaatttcatctaagaatcccgctctaaaataagaattctcattcgcactgggcagcaatggatcaatatctttccgccgcttctccggtaagtcccggatgcatgaggcacggttcataatgttttgccagtattcttttgcattattggcttttgagaaacggcaggatatgccgataatggcaatatcaaattgatttttcttggacttatcagataatccttttaaaatgcgcaaagccatttccctgtccattttttgctcttttacttgctccaatacatattgttttataatcgaaatatcatccacgattaatcacccctatcgattttgattctatataaaatatgagaagcatcatggatatatagaatagctgcttcaattgaagcagcttattgaattagttaatttttgtctcaaaaacctttccatcttctttacataacacctgcaccagatttctggcctgtaagacaacactcggaagacctcctcccacttgactccaatgcccaaccatataaaagtctttaagtccgggaagtgaacgtttcagttttttctcgtgcatgatgccttccatctgtttttcccagccctgccagcttccatttctattatttgtgtatcttctgatcgtatatggggtggatacatcagtcacgtcaatatttgatttaatttcaccaaaccatttgtctaattcatcaatcattacattcgcaattgcttttttctcttcttcatatttttcgcggttgtttttttgcaaagtctcccagtattcagcagaagttttcgcatacacgataatactcgttttgccatcaggcgcgaatgaaggattttcgttatatattttcacaaatatgtttttaacgttgtcacagccataggcgttaagaggctgttctaattccagactcaaataatgaggatatttttcaaacgtttttgatacgcccaatccgacataaatttgcggtgcacttgttttaaggttgtcataacaaaatgtcagttcatcatctgtatattttccatccagcatttcaaaaatagttttatagccatccgctgctgaaatgacgatatctccataatgacactgtccgtttttcagctctattccgatcgctttatcattttctactaaaaccttagaaacaggtgatttatattgaatctcaccgcctaattcaacatatctggcttcaataatttttgcgaattgcagagaaccttctacaggatgtcctgaagatttgctattagcccagcctaaagtagccataaagtaagatataggggtatctacattaaaccaaaacagacgatttacattttctcttacaaaactgcttttaaagcgctgggcgaattctttgatcgtcacttttccccattgccccattactttcatgtaagggccagcctttgctttgaaggcctcaaagtctgctaaatcgaacagttcgggcgctttatccaaatccagctctacatcagaaacaactcgaatgccatcagttaaaagcttaattgtttccgcatcttcaggtgcaactcttaaaaactcctgttctaatttatctacatcagcatacagcgtaaatgtatcaccatttctaaagttaacaaccgcaaattcttcatcattaatgaattccatattttgtattacattcagttctttccaaaatttatggaaggtattgttaggtcctgaaccgaccagccagctgatacaaccgtcaaaaaagtacccttttctcttccagccggtacataaaccacccggcagcaagcccatttcaaaaattttcgtgctgtatccgttcatttgcaagtaacagcccgcggccattcctgcaataccgcctccgattatgattgcagtcttgttttcttctgtattcttcattaattttccccttttccgaaactagttttctagaattttcaatccttcttgtatattgattttgccgttctccaggtcgtcaaatagattgttgagttcttgctcaagccgattttcagcagtatcttcttccgtttcttgctgatgatctttattcagctgcttgtcaatatactctgatagctccactacagaggaatatgtaaatatatcggatatatccacaatgtcaggatattgttgatttatcagttttaacagttgggttgccataatagaatcgccgcccatggcactaaagctttcatataaatccagctcttgcatatccaaaaccatagagtacatttgcgcaatacttttttcggtatcagagtaaagttctccctttcctttcagcactatatcttcagtatctgttcttcgacgtttttctgcttcgttttttgtcctgtttttatctattaatttgtttttgatttgctcagataattcaaaagacaattcatccttcgcaaaagcgaggagcttcatatttaatgtacctggaatgatattagtaagcttattcgatgctatttcttctaaaacggaaatagccctttctaccgtcaataatctgaaaatagagctctcatcagtaattccataatcgacagctatgccgacctcatcccaagccggccagttaattgacagcgtgtttttcccctgtttgttttgcatataagcaaaggaatctaaataagcatttgcagctgtataatctccctgtccggcacctccgaaaatagaattaattgaggagaacaaaatcgtgaaatctaaatctacgtctctcgttaaatgattgataacccatgttccattaattttaggagcgagcacttctttaaaaatattagcttcttttctaaagaggaaaccgtccccggcaactccggcacaatggaaaacgccattgatcgtaccgtatttctgttttatttcttcaattaccggctccatgctgtttaagtcagaaacttcacagctgtagcaatcaactttagaacccattgactcgatagctctgatggacttcagttttctgcaaagctttaaatccgttccatcagcaatgatatcgtcccatcggctttgatcaggcagtttagagcgattgagcaatacagcattgacgttatgttttccagccaggtgctttgcgatctccaaaccgattccgccggtgccgccggtaatcatatagacaccgttttctttaatctccataccgccgtgtttcttatcctttatcggttcaaccgtatccaaccgactgatataccgcttaccatccctaaaggcgacttgatagtgtttcccttttgttcttaactcctcactaataatttccggtgaagtatgttcatcaatatcaattgctttacatgaaacattttggaactcctgcgaaataacacgtcccagaccaaacaacgcggcgcccaatggattgattgtattttcttctccggacacttctgtcacaagatcagaaataagatgcaaattaatattgcttttcatcttattcttacttaatccccggactaagcggaacaggctgtatacgcctttattctgcatgtcttctaaatctgttaatgattccgttccttggcggctgatagaagacatatgtataatgctgctgatattttgatcgtttatgctatgcaataattgaacatagtcttcttctgatccgctaattaggaatttccgcccatttatcttctgaaattcatccccaaactccacttcaataacatcatcgtcatgaattttcaactgttccagtatagatttataaatttccatgttgtctttaaataacagtataggacctgttacctctgttttttcttcttcaaaagcttcttgcgccatccattttaattgataaagtgattcagaactttcttcaaaaagggcattaatccgatttactttttttaatacataatcggtgatttctgcaaaaacatttccttctgtatctattaactgaatatcacacagctttgtctctttactgcttgcgttctttttgacaaatgcataaaaatgctgcggcattcttgagtaaatcttcacgcttttatatgaaaaaggaaggaatgtactatcgtcatcatcttctccaataaacacgttcactgcattatctagcaaagcgggatgtaaaaagacgtcttttaaatctgctgtaaattcatcagccaattttaattcggccaattgttcatcagggcccagtatgacttctttgaagttcagccacctcggtccgaaagtaaagactttgctgattaaaccatttttattttcataattgacttttatcttctctctattactgtcattcctaacagagtctaaatcaaacattgatacagagtctgttaatggaaacgcttttccttctgcatgtgtaatccaggtttctccttcctgactggctattataaattgaatacattctttctttttcttaatgattgtgtgtacaatcttattctcatcctcatttactgttaacggagtgaagaagataatatctcgtaattctaattgattgcttttatagtaagcggcacttgctcttcttcccatttcgatataagtcgttcccggaataacgcaagcccccatgattttatggtcacttaaaacccaatccttattcacattaaatgtcgttgaatagatcgtctcattcattgaatcagccaaacactggtcaatcagcgggtgactgatatttttctgatgcggcgcttgacctcttctgtcttttacttctccccagcataatgttctttcaaattggtatgtcggaagactgacaatctttctgcgctcatccttgtacatttttgtccattctacttttgctcctctgacatacaggttgcaaatttccgtaaggtttagcagtaaatattcatccccttcagtaagaatgtcatgtatcaaattgtcagattgagcattcattttgcgatgttcagataaggaaatttctccttcatccataatctgttttctatcagaaccaactttatggaaagaaaaatatacgcctttttctgatatttcattcaggttatgccctgcaagcctgccgatttttctctttaattcttcgtaactttttacaatcagagccaatcggtagccgtaatggccccgccctgtgtttgctgtatagcaaatatgttttacgtttttttgagttccttttttaaagaattcattatattccttgatgagtttcattaaagaattctctgttttagctgataaagtaaatatctcaaatgtttcatttgcaggaatgacctcttcaacctcatctccagcatcttcaatcactacatgtgaattggtccccacaaagccgaaagaactgattcccgctctcctcggtgagttatttttaggccattcatgggctttgtctgtaacaaatacaggtgacttcacaaagttaatcaatgaattcggttctttaaaattaatactcggagggatgacttgatgcttcatagacagaacgatcttgataagtgacgccaaacccgaaacggcaacggtatggccaatattagatttaacagatccgatcccgcaaaactgcagcttgtccgtatattttgaaaacgcattggaaatcccctttatttcaattggatctccaagctttgtgcctgtaccgtgcgcttcgatatattgaatggtttcgggatcaatttgagcattttcccatgcctgaaccagtacttcttcctgggcgatggcatttggagctgtcaatccatttgaggccccgtcattattaactgcactccctttgataacagcataaatatgatctccgtcctgcttggctttacttaaaggttttaagatgactgcagctactccgtcactgaaaaatgtcccgtctgcgtctttatcaaatgagtgtactttatcacttactgattccatcattgattttttggacgttttgaagcgcggaaagaatcctaatgaaattccgctgacaatagacatatcgcattctttatttttcaaagcattacaggcaagatgcacaccaagcagccccgagctgcaagcagaatccaaaaccatagaacttccttttaaatttaataaataattaatccgccccgccatcaaacccggccagttgcccgtcatacttgtcgattctgattctgtaatgtagcggtacaacgtattattgacatggtcttttccaacaaagagcgatgtgttgcttccataaattttgtcccctgcataccctgcatcttcaatcgcagtccataccgtctccagcaatactctgtgagacgggtcaatggcctttgcttctttaggagaaatattaaaaaattcaggatcgaacttgtctacgtcttctaaatatccgccaggtttccagttatctgcttgttcttccgtcagatatcctgaaccgagaaaatcagtaaaccctttattgtttacgatcggtttaatgtaattgatcatatcttttggatattccgctttgcagtcttctccattcatcagattctgccagtattcatctgtattgtttgctttcggcagtctgcaggaaattccaatgatagcaatatcttcattgctgcttgcagcctttaattcttttagcattcgctttgcttctttctggcttagcttatgctgtttcacttgttcaaatatataagattgaacgctattcattacggatcactcccgctttctttctaagaaaatttttgataggaagggtaataagatctacatttttaccttaaaatggaattcagttcccgtaataatgtgataggataggcaggctgctttttcttcattcaattcgcagcctgccaatatccattttgcgaatatattcttacaggcccaattcagttattttcggtctggatgaaatatttgatttgcttcgctgacttccatctctccggatgccagcttattcaaaattgcatccaggtcatcttcattgtcttcttcagggattcggtcagaagacttctgatcactgaagtgggattcaaggtaggttgacatctccttaatggagggatacgtaaaaatatcagaaacatcaatgagagaaggccattctttctctatttcttttaccagatatatcgcggatattgaatctccgcccaaatcataaaatttatcagttatactgatttgttctaagcctaaaacttttatccaagctttcattagtttattttcaatatcgctgaagctaaatgtctgatcggttttcgactcaacagatttttttacaatcgcctgctccttaaaagtcaaaatatccggagataatcggaaatgaatttgatcttgatttaattccagtacccgatgatcaatttccccgatgatcacattccggatgtccttttgcatgacttcatcgaaggcacgtatcgcttcagctgaggtaatcgtcttaaagccgttttcatctttatgttcgtttccggccttttgacgctcttcaatatattcggcaagcatgcccacatccgaccagccgcaccaattaatcgtaactgttttttcatccggtcttcttcgctgtctgcgttctgcaaaggaatccaggtaggcattagccgcagtataatcagcctgccccatactccccgcaagtgctgtgatagaagaaaacattatgaagaaatccagatgctcatgctttgtcagctcgtttaatatccatgttccattaactttcggtctgagcacgttatcaaacacttttttttcctttctgaaaataaacccatctccagaaacaccagcactatgtatgacaccgtggattgtattgtatttactctttatttcctcgaatacatgaatcatttcactttcatttgcgacatccgccttatagtaatctaccttagaaccgctttcttttatttcttttagagcatcgattttcttgttgtttcccttctccatgttgatctgctgctcggagcgtccaatgaggattaattggacattttcttttgatgataaatacttggccatttctaatcccagtccgcccataccgccggtaataacatatacaccgttctttctgatgcttattttcccttcccgaattacggataagtcttcagtctggagctcttgaacgtatttatgccggtctctgtaagcgacaagctctgactgtttttttgagttgatttcaaacaagatgctttccgccataagattttgatccaaatctatgcatctgacacttacacgcgaatattccttttcaattacttttccaaaaccgaaaaatgccgcgttatgcgggttaatgtctggttcttcaccgcttacttgatgtgcaaggtctgcaaacagcatcagttctatgttattttttgtattttctacaagtgattttgttaaataaaataaactgtctacccctgaggatatttttttctgaagctgatatatgtttttgtctttctcattgctgatagacatcaaatggacaatctgagaaaccttttcactttgaagagcttttacaagacagtcataatcttcttgagaatcactgacagtataatgatggcttccgattttagagaaatagtcaccctgttccgcgacaatcacagttttcccttccagttctaaccttcgaatgatttcctcggataaactgcagccattattcttaaataataaaataggatgatgaatttctcgcatctcgtgtgattgatcgctttctcttatccaagatagcttatgatatatattgtttcttttagtcttttcagctgctttatgcaccctttttacgatgtaattgttgatttcaccgaaaacttctccagtgtcattcagcaggacgatgcgaaacgttcctgtttccccgttgcttcggctctttttcttgatataactgtaaaactttttagaagcagagccataaatcttaaattctttataaaaataagggagataggtttcgttatctattgtgaatgtcccggcattaacggcacaatccatcatcgcaggatgaagcgaaaactgaacgaaatcactctcatattctttcggcaattccaattcacatagaagcctgtcgtcgtctctgtagattgcgttggtgcatttccatctgcctccgacttgaacgatgctttccggtctattggtatcttctatatgataaaccgacttgtattcatcggtgtttatttccgtcaatggatgattattacgttgaatgacataaacagaattaaagcttttctttaaatcctcaatgtcatatgtttcccgtaccggttcttctttcgcaatgaccgcttccgcgtgttttatccatttatcgccggtcttacttatcacactaaactctaaaacgctgtcctttttctttatgatcgtatgaacttctttaacttcatttgcttttacctttaactgatttgaaaacgtaacgtcttttaacagaatgccgacaggttcgccgaagtattttcttcccgcttctctagctgtttctatataaaccgttccagggataacgtaagaatcattcactttatgttcatttaaaaaccaataatcagtgacattcaaatgggatatatacacttccagattcagtgactgcactgcaagattgctcaataaagattgttttttctcatcggctgaagggccgtctgcagccagctcagcccataatctttttccgctgaatttgtatgtcggcaagctgaccttttgaaaattcatctcgctataaagatcttcaaagttaatattcgccccatcacaatacatttcacataaaatatgtaagtcagaggttggaatattagagacgtcttgtctgactctttgaatcacattttttattgtttgagtattctgcacactgtctgtatgcgtttttcctataaactttgtttgatttgttatcgattgaaagtatatatttttctcccgatacgttttccattcagagcatgataaaaactccagcttttccagcagttccgcgacagagcttattaccatagcgagtctgtatttgtttggcaatctcccagtgtttgctgtataacatatatctcccagattcacatctgtttctctctttaaataatcaatatgatctgtaagcaagtgcgcgagagatgttttagtcctagctgatacagtaaaaatatgttcagataaaacggattgatcgactttttcaactgcgggtgcctcttctaaaatgacatgacagtttgtaccgctcagcccaaaactgctgatgccgcacctgtatactccgctgctctcccatgctgaaacggagtcattgacgtaaacaggcgattcatgaaaattgatatttcggttcggcactttaaaatgtaaacttggcggaatttttttatgctttaatgccattaccgctttaattaaacccgctattcccgccaaactatcaagatgcccgatgtttgttttgactgaagatactgcacagaactgttttcggtctgtatattttctgaaagcccgttgtaacgcatttatttcaatcggatcccctaatttggtccctgtcccatgagcttcaatatatgtaattgttttaggatctatttttgcatttttccacgcatctactattacttgttcttgagctgctgcgttaggagcggtaattcctactgagctgccgtcctgattaacagcgctccccttaatgactgcatagatctggtcatgatcacgaatcgcttgggccagcggcttcagcaatacggcagcgactccttcgccgctattcgtgccgtcagcagaatcatcgaaagtccttacagcaaaatcagatgaagaattcccgatatttaacctgctctcctctattgtctttgggaatacttttatattcactccgccggctaatgccatatcgcaatccttatttcttattgcctgacaagccgtatggagggcgacaagcgatgaagagcatgcagtatcgattaccattgctggccctttaaaatccaagatatatgacagtctgcttgcgataactgatttaatgttacccgcggtagccagtccgagtaatgattgatctcctttttcaagcaatctgaagtattcatttgagccgtcactgctgagtccaatgtatactcccgtatttgtcccacataattttccgccgccgtaacccccgtcttccaatgcgttccaggccgtttcaataaataatctttgtctgggatcaatcaactttgcttcatttggaaggatactgaaaaagtcacaatcaaatttatcaatctcatccatataggctatttttgtataggctgcatctttactgtacttggttccgctgttttttaatgactggtcagcatctttttttctgttcagaggaatgtctctgatgaactcttttccttgtaaaagtaaatcccaatattcatttacgtgattggcttcgccgattctgcatgataaaccgacaatggcaatgtcatctccggaaatgtctttggtcccttcctcgtttttttgtttctttacattaggagtttgatttgtaaaagcggccgcttttaagttacttaaacttataaagtctgttttcatttttttacctcgctgagaatcactagataggtgatcatacctgtcaaacttcaaagtcttcaaagtgtttttttgtgtttgtttcagaaaataattgattaaatctttttttctgttcatttataggggttttttttgttcgaaacactgacttcagcatttctactgccatatgcatttgttctcttgacggctgacgacctgatgtttcaagttcagcctgtatggcagctactttttcatatggttcgattacacctttggcgtattcctcattgttccagttgtaatttttagtagcaaccgcgatccctaaacttctcgagataatagaaaaaccggcttgcagtgaaacagattcgttcaaaagagtctcttttataatcttcacgtcctcttctttgtcgtagctgtacgatttgatgtcagcgatattgtttcttacaagattccttaatacagatttcggcccaaattcaatcacagtatcagtatgatttgcttctaaatacttcatgattcccatccaatttaccggttttacgatttgagttcccagtatgtcagccatttgctgtttatctgaatatggaagagccgtcacattagataaaactttgtattttggagttctgagatcatacttttttaactcatggctgaatttttccgcagcaaaacccatgatcggagaatgaaaagcagcacttacatttaatttaaaaatgtctgctcctctggctttaagagtttcactaagctcttcaactgctgccgcttctccggataccacaacatctttatatccattgtagttagaaacagcaatcgtttttcctcttgaagagagagattcgcactcttcttctgctattctttcatccaggttcctgataacagccattgctccggtcccttgttcggcagcttctttcattaataatcctctggctctcaccagctttacagcgtcctggaaatccaaaacgtcactgcaaaccaaggcagaatattctcctaaactatggccggcgatatattcaggttcttttccgacctcttccatgtagattctgaattgtgcaatacttgttgccaggatggccggctgagtattttctgtttgagatagctcagcggcacttccatctatacataatttcttcaggtcaaatcccaatgcatcactggcttcgtcatacgtttttttagcgataataaaattgtcacataaacgtttgcccattcctgcatattgagatccttgtcctgaaaataaaaaacctattttcgacatttaaatacctccaaagtccctataatgcctgatttgccttacattctgccgatcagcaaaatgtaaggcagaaccggccgctttatattgaattgtctgctttgtctgctgtaatcacttgaatcaaattcatgtagttataaaataaatctttcattttgtgctcatttagtttctgatggttatatataaaaacgatttctgcttcggatggcttttcatgaactgcaaaaaccagatcatataattctgagtactctttttttgattcattactaatataaaaaagaggaaaaacatcttgggccgaacttgatttcttatagtgagtattcaaatcgtattgtgaatcctcttgattctcaatctgctccttcgccatacgaataatatcgtgaaaattctcgatatcagacagatcaaaagacagctgactcatccgatcatctccatgacccgaaaattggatatgaaccaagttttgctggctgacatcagctaataaaaatacataacccgctaataaaacatgagaaatatcatatttgtaggtattgcatattgtttttaaaccatcataataattcgcatttaccgcatattcgtgcatggctgtatgactttgtccagttgattccgagatgtattcaagcggtaaagtaataggaatgatttctttttccaaggacactgctatctccgcaaaggctatagctgattctatatattcggacaatctgtaaatagtcggatatgcaaacaagtcagcaatttgaatttgttttggatacagcttctgaagctcattataaactgcaacgattttgattgaattaccgcctgcttcaaagaagttatcatgtattccaggctcttctatttttaaaacatcggtccaaacacggctgatacttttttgtacatccgttaccgcttcctcaaaaggccggtcaaaacctgttctatctataacaggttcaggcagtgccaggacatttatttttccgtttgctgtcagcggaatttggtcaattttcataaagatctgcggaatcatatactcaggaagcacaggtgataataacttaataaattctgaaggatatacagtgctttctgccacataatacagaactaaatcttggactcctgcggaatttgtttttccggcagctacacattccttaactttttcatgttggtttactatgctttcaatctctcccaattctatccgataccctctgatctttacctgattgtccattcttccgataacgtccagttcaccatttggcagccaccttgctaaatctcctgtcttatacatcttggttcctttaacaaacggattgtctacaaacttttgcgcagtcaaatcttcttttcctaaatatcctctggccattccggctccagcaatgcataattcgccagtactgccgagcggtacagtgtttccatcatgatctactatatatatctgtgtattcgcaatcggcttgcctatatttacactattttcattggttaagtctttcacagaagaccaaatcgtcgtctcagtcggaccgtacatattatagatcttcagatttttatatttttttagctcaaataacaattcccgttgaaatacctcgcccccaaccatgatggtcttcaatttctgaagactctccgtactgttttctgcacttagcatcagctttaatctggatggcgtaagctgaatagtattgacatcagtctcaacaacgatcttgtttaacaagtacggatctctttgttccgcttcaccggctatgacaactttcagcccttgagttaaaggcagcagcgactctaatccgaatatgtcaaatgagcacgtggtgaccgaaagaaggacattgtcttgtgaaaagctgatcctgtctgttattcccttaataaagttatgaacggcacggtgctctacggcgacccctttcggttttccggttgatcccgacgtataaatgacatatgctaaatcttcggccctgttaataacatcaatgttcgtctccaactgatgtaataaatcctctgaatctatgttaaatatggttccgctgtacgttaattcatttggaagtccttcttcagttaacagcaggccgcttttactgtctttcagcatataattgatcctgtctgccggataatcaggatcaagcggtaagtagcatccccctgcctttagtattcctaatattcctataatcaatcggaaagaccttcttaccaaaataggaaccacaacattctctttgatgccgttttccctgagggctcttgccaattgatttgccttattattcagctccttataggtcaagaagtctccgttccattccagagcgattgcatcaggtgtccttaaagcttgctcttcgaagagctcttgtaacgtcttttctttcttatatgataattccgtgcagttgaattctttcaccagcttttgtttctctgtctcatttaccatatcgatctgagaaactattacttcatgatcagccgctgcctgctgtaagatgctaaccaggttatctaagattgaacttaccgtttctttactgtaaacactggcgttatatgtgattttcatatgcaagtcgtcaccgggagcaattaaaagctctaaatcatagttggtttgttcaaacccatgttcagcagttatttttacactcgaacgggctgaatcttggaaaagatcctcactcaacgggtaattttcatacacgactacgtgattgattaatttattcttcatacttgtcaaagactgtatgtctgccagagaacaataactgtattcgttcgcttcaataaagtctttatttatttgtttagccaatgaaataaatgatgtatcacattctcttttcactctgattggcactgcatttataaataagccgaccatattttcaattccgtttatctcactcggtctgcctgaaacaatggaaccaaataccacatcatttgtattgttatatttctgaagcaatatcccccatgctgtttgaacgatagaatttaatgtaatgctgtttgactcagcgatttttttcagcttagcggcggtttcaccgttaagcgctcccagtttttgatcatgctgatactcgtcagatttcaattccagttccggaaatgagatctcttgttcatatgcagaaagatattccttccaatattcaaatgcacggtccttgtcctgctgatcaagccattcaagataacgactgtacggtacaggtgattcttgaaggagttttttcccttcagccacgtcaccatatagatccataagctcttttaacaggataccgacactccagccatccaaaataatgtggtggaaactgtatatgactttaaatttatttcttcccagcttgatcaccgatactctgatcagacaatctttgttcagatcaaacggagtattcctgtctctcaccttgaattgccctacaaaggcatccttcttctgctcctcccattggctgatatcatgatattgaatgtttagttttctttcttttaaaatggcttgtttaaatacacggaaaccgttatagaaaaatgacgttcttaatatttcatatttagcaatcagcctgtttaatgcgtcactgagaacttctgtattcagatttccttcaactgttatttcactttgttcgaaataagcgctagattgatggtcaatcacagcgttatacagcatgccttcctgcatcggtgaaagagaatgaattttttctacttcagcaccgcttgcaagaatttgatttagctcctctatttgaagatcgggatccccataatcccatggagttttctcagatattttcttattcacacaatgttctatgatctgatttattttcaattgataggctttcgtaaattgctcaatcgtctctcgtttatattggtttgcactgtaattgaacgtaaacatcagcctgccatccatgatatatccatttatttctatactatgtgtctttttatttcttccagatatgctcgttccggcggacaaaggtgatatttgaaataggttgctgcgatcttcttggccaaattcacccaagtagttaaaactgatatcaggttttaattgaagatgaaccgagtccgacaaatatctgagtattccgtaaccaatcccgttatgggggatatgtctaagcatttcctttgtatacttaatggagcttgataaactattactttccgtcatatcgagaacaattgggtatattgtcgtaaaccaacctattgtgcgatggaccggggtttttataacactttcacggccgtgcccttcaagattcacaaggatcttctcgttgccggtccattctttggctgcaagtcccagtgagcaaagcaatatatcattaatttgtgtatgatatgctgcatttgtatttcttaaaagtgtttttgtttgatcctctgttaattcaattttaatttctttactatcttcataagagcagctttcggcaatgaaatcctttggaagaggttcaataatagccgtttctatggtctcccagtacccagcttccttttgaagagccttgctgtttgcatattctttcaattgacgcgcccattctttgaacgatgctgttttagtttccagctccaccttgttcccattaactgtttgaagataagctgtttcaaaatcttccaataggattctccaagatactccgtcaatgatcatatgatgaatggttaatagaagatgatctccgtttttggttttaaataccgccagttttattaaaatccccttttccaagctcaattcgttctgcatacggtcagccagtgattcaattgccatggctggatcttctgtttgtgtcatatcaaatacttctaaagtaaatgtttcttttgcctgtttaatgcccctattccattgcttaatttcaccgttttcctttttaaactgcatcctgagggcatcatgatgcctcaccagttccaaaaaggccgtttcgattgctttttcttctatgccggactttttgtaaagcataaaggcttggttatagtggttttcttgttcaaatctctgttctataaaccatttttgaatcggtgtcagatcaacgtctccttctacaatcgactgatctgcttgtatatcagctgattttacgtgagcactcaagtcttttatgtgcggatatttcattaaatctctgacttccagttttaagccgtatttttggagttcggaaactactaaaattgatttaattgagtctccgccgatctcgtaatagttatagttaatcccgattgatttcatccccagaactttctcccatacgcatgcgagaatttgttcctttttatttcgcggtgcttcatatgcagactccaatacatccgcaatatctataatcggcaatgatttcgtatctatttttccgtttgaacttaacggcattttttcaatctggaagatataacttggcaccatatataacggtaattctttagacagattttcttttaaagcataaacatctatttttttgtcggaagtaacataaccgcagagatatttatccccatgttggtcatctctcgctacaacaacagcctctcttatgtgactcattttcagaagccggttttctatttctcccgtttcaatacgatatcctctgattttgacttgatcatcaattcttcctaaataatcaattgtcccgtccggcatccattttgccatatcccctgttctgtataacttagccccgggttcaaaggggttatctacaaatttttctgacgttaagcccgctttatttttatatccgtctgcaagtccttctccgctgacacaaagttccccggctgcccctaaaggaagtaattccaattgttttcctaatatataaagcttagtattatccgcaggtttgcctattgatactgcattgccattgtctctttcaatatgatattgatgaatcatacacccgactgtagcctctgtcgggccgtattcattgtagattttgacatgaccgttaaatgcaccgtgtatcttttttgcaagcccggttttcagctcttccccgccgacgattattttttttatctttgacgtacttaaatctacattctccagcaatctcaaatgcgtcggcgttagcttaataatatccgctttattttcttctataattcttctgatcagaagagccttgtccggtccctcataaataataattttatttcctgaaataagcggtgtataaattgaagtaaccgttaagtcaaaagaaatagaagaatacagaggaaaatcaatatcttcatcatttacatatatcttatttgcccaatgaatataatttaccacgcctttatgttttaccatgacgcccttcggcagccctgtagtccctgaagtataaatcatgtaggcaaggtcttccgggcaactgacattcggcagattacttctgttatgcatatatagagtaggatcacttaatgataaaatttctttattgaatgtaataccacctgacaatccgttttgaattaggagaatgtttgcatcactgtctttcagcatgtaatttactctttcatcaggatattcaggatctatcggcaaatacgctccccctgctttcagcaccccgataattccgatgatcatctcaagagatctctctgtcatgattccgacaatgctgttttctctaattcctttttgtctcaaaagattagccaggctgtttgatttctcgtttagttctttataggttaatagcgtatcttcttggacagccgcaatacgttcaggtgttttttctgcctgctcttcaaataattgatgaatcgttttattccgaggaaattcagctgccgtgtcattgaatatatggagcaatgtgtgcttctcctgttcaggaatcaaatccagtttcattaaaggttgatctaggccggcagctgcactttgtaaaagcttcgtaaaatgggcacccattctctcggctgtttctttttcaaataattgactggagtattccaagtggaacttaattcctttatcaatttccgtcgcggttaacgttaaatcgaattttgaaatattgatctcggtttgaatatgctcttccggatttggatccaagtgattttcaataccgtaatctgcattttcaagtacaaacatgacatcaaacagcgggttccggctcgaatctctttttaccccgagtttttgaacaatattttcaaattggtaatctgtattctcaaaatcttttaacgtatgatgtttgacctcttctaaaaacgctctgaatgttttatgttcctcaggaaaatttcttatggcgacggtattgacgaacatccccaccgtattctccagttcggtgtctgaccttccggactctgccgttccgatgatcacatcctgctgaccgctgtattttgaaagcatgatattatataccgccagcagcaccatgtacaaagttgttcctgtttctttcgccaccgactttaagcttgatgttaacctttcatcggccgtaaagctgactcggcttccttcaaagcttttgactctcggccgctcgtaatcagtctgcagattgagaatcggcagatctccgcttaaccgcttaagccaatactcctcttgttcctttaacgcctcttttgttcctgagcttacttgccattctgaataatctttatattgcagcggcggctgttttagtttatgacccgcatacagcgcattgaattctttgcggattattccaaccgatacaccgtccgcagcgatatgatgaacatctaacagcagcagattccggtcttcatacgttatgagtccggctctgattaacggtgctttgtccaaatgaaagggtctgataaactgcttcacatatggtcgtatcccatcagacggcagcttctgataattaaattcgagctcccatgtatcgtgaataatctgaaccacatcgccgcttacaacatcgaaacttgtccgtaacgcttcgtgtctgccaataatctcttgtagaactgattcggcttttttcacatctaattttccgtttagttcaatcataatcggcaagttataaacgatactgtctttatccgtctcccaaagggcaaacattcttttctgagcagatgacgcttgataagaagactgctttctcgctttactgatgaccggataattctgtttatcccgcttttgaataagacggctcaactgtttgatggtaggctgctcaaaaagctccttcacctttatatccgtgccgaatgtttttctgatgcgggaaatagtgaacgcagctgttaaagaatgtccgcccagttcgaagaaatcttcatttatactgatccgtttatgcccaagcatttctttccaaatttcagctagtttttcttccgtttcatttgccggagcttcgtattgaggtactgacaaccgttgcaagtcaggaagaggcagctcttttcgattgatttttccgttagctgtaagaggcaactctttcagttgtattatgaaactcggaatcatatacttcggaagaacctgtgccaatttctcctgtacgaacgagccttccatctcaatgtccccagtaatatatgcagaaagatatttctcctctatataaacaaccgccgcttcttttataccttccagctgtaatagttggttttcgatctctccgatttcaactctaaaacccctaattttgatctggttgtcaatccggcctaaaaattctatatttccatccggcatccatctgccaaggtctcctgttttgtacatttttgctccacgatgaaaaggattatcaataaatttttcattcgttaattcttcattattgacatatcccgatgctaaacctaccccgctgatacaaatctcaccaggtgctcccacagggaccagttgatctgaacgatccacaatatagatattaataccgtgaattggtcttcctattctattgtatatttcacagttttgaatatgatctagatcaatgctatgtgcaatacagccaacagtgctttcggtcggcccgtaatggttaataaacttcatccatctgcatttttcagcgagctttttgacgttgccgatgtttatgctttcgccgcccagtataataacttttaaatcaggacaagacgccagcatgtcaacatcctccatcaatgttgaaaataaagtgggtgtcattttaagatatgtaatactatttttatgaatatattctattaatgatagagagtgaagatacacttctttatcaacaaagtggacttgtccgccaccggataaaactggaaatatactggtatagcataagtcaaaactatattttgacgtcactaacgacctgctgtcagaatttatgtttatttgatcacatacccataatgaataattaactaatgatttatttttcaccttcacccccttcggttttcccgaagtacccgaggtatatataacatatacctcgtcctcgagatcatactgaacatcagggtttgatgtattttggctggtataaatcgatttatccgtaatatccaaacattccgccgcaatgtttttatcagctaaaaagcacaaatctgtaatgaggatatcagctttgctatcttttaaaatatgatttatccgactgaccggtgattcatcatcaataggcagaaacgcacttccggtttttaaaattcccagcatcccaatcattgaatattctgaaggacggatcatcatagccgtaatgctgttttttcctgcccctttttccattaataatgttgcaacttgatttgccttttcgtttagctctttataagtgatatgctttcctgcatagacagccgctgtttggccaggtgtcttttccgctcgttcttcaaaaaggtcttgtatcgttttattcaccgtataattagaggactgcttattaaaatcctggagcattccgcgctcttcttcatttacagcgctgatgtctttcaggacacgcgtaggatcagttgccacttgctttaacacatgacagaaattaacacctatacgattaatgatatcttcacgataaacattattgttatacgtcatctctgctttgatttggctgcctggaataataaccagcccaaagtcatagttcgtctgttcaaacacttccatatctgtaatccttaaagcatcagttgtattatcgaccgccttgccatagtcatcaacaggataattttcataaaccaacatatggttgatcagtttctctttcatctttgtaagagcttgtatatccgctaaagaactgtaaccgtatgatgtattcgctttgataaagtcactgttcagcttttgggctaatgctataaataccgtatcaccatcgccttttactctcagaggaaccgcattgataaataaccccaccattttttctatgccttgcactctgcattgtcttccggaaataaccgcaccaaaaacaacatcatccacgttgttatacttctgcaaaagaactccccatgcagtctgaatcaatgcacttaaagtaatgtgatattgatcagctgcagctttcaacatcgaagtacatgtttcatcaataatgaatgttttcttcctattattgaaaccgccctcatcagcagaactttggaataccggcttgctgctcatattcatttagataatccccccaatattctaatgcggcacttttgtcctgattatccagccattctaagtaggtgctgtaaggctcggtatgctgaagcactgtctctcttccttcttttaatgacgtataaatagtttttatatcattcattattaaactcatacaccagccatccataataatatggtgaaaactgaacagcagtttatattctttctcatcagtttttaatacggttactcttattaagcaatcattcgtcaaatcgaatctcgttcccctgtctttaaactggacatttttaagccggactttcttttgatattccgagaaagtgctgatatcttcaaattcaattttaacttttctctctcttagaacagcctgtttaaacttacttaatccttcatgaaaaaagcatgttcttaaaatttcatacttctcgatcagcatattaaaagctgtatttaatctgccaatatcaagctgaccggataaagaaaatgtaagctgctcaaaataggcttgtgaaaacggatcaagcaatgcatgataaagcatcccgctctgcataggagtcagggagtggattttctctatctcttttccgcttgataaaatctgctccaaatctccgatggataaatccagatctccatagtcaaagggtgttttttcaggaatttttttcattccgcaatgctgaataatatcgattaaccggtttatataggattcggttaatgttttaattgtttcttctttaaactctttcgtactatagttaaattccaactgcagttgaccgtccataataaagctgttgatttcgatggcattcaattttttattagataaagaaacacttgtaccagatgatatatctgcatgctgaaaaacagcccgctttttttgagagatttctcccagatagttaaacccgatctcaggctttatcgtaaaactgatgtcttttttatgtgccggtgccgtcaagtatttaataattccgtaaccaatacctttatgaggtattcttcttaaatactctttcgtattttttatgcaataaggcagatcatcactgtgctccatatccagcacgatcggaaatagtgaggtgaaccagccgatggttctttctattgaaatattttctaatatgttctctcttccgtggccttccagaccgattaaaaccttgtcaagtcccgcccattcttttactgccattcccagtgaacaaagcaagatgtcattaatctgtgtgttataagctgcatttgtattcctctggagcttatcagttaactgctttgtaagactgacagtaatggtgcggctttccttaaatacactgtcagttttattgaaatctctcggaatttctttaatcttcgttttctcgatattctcccaataccgaagttcctttcttatctcacttccgtttgcatattccgccaatttacgtgtccattcttgaaaggatgccgtttttggcggaagaacggccggctctcctttttgcagattgttgtagacctgctccatatcttcaagcagaattctccaagagactccgtcaatcaccatatgatgtatagcaataagtagataatcgcccctcattgttcgaaataaaccaagtttcattaaaagtcctttttcaagatccattccgctttgtaactgatcggcaagtttttctattgtatttttgtaatccgtatcagcaagcagatcatatatgtccagagtaaaagtatcccgggcggcttggacatctctgacttcttgttttatttcgtcattttcggctgtatatatcaacctcaaagcatcatgatgctttactaataattcaaatgtctttgccagagcgtgttcattaattttttctttcacttgaaacatgaatgcctgattaaagtggtgaatgtccgcaaagtcattctctataaaccacttttgtatcggtgccagttcagttctcccgctaaccgggctctgatctgtttgagctttatataatttcacgtgtttactgaggttttttatttgcggatactgcaaaagatcttttacctctagactgagactgtatttttgaagctttgatacaatcagtatagattttattgagtctccgcccagctcatagtaattatcattaataccaatatcatcaattttcagaacttccgaccaaacatttaccagaatctgttcgacttcggaacggggtgcttcaaggtgctcctttatatgtttaggctcttctatttctgcaagtgctttcctgtcaattttcccatttggtgtgagaggcagctgttcaacctggatgatgacaccgggaatcatatattgcggcaaaatgtcacccaattgctccctcaaagctgctccggatattttatattctgcggttacaaatgcagaaaggtatttgtcaccgtgaaggtcgcacttatctataacaactgcttcttttatcccgcttattttcagaagctggctttctatttcatcagtttcaatccggaagcctctgattttgacttgattatcaattctccccaaaaattctatgtttccgtcaggaagccaccttgccaagtctcctgttcggtacattttagttccggactcaaatggatgatcaataaacttctcacgcgtcattttctctttattgagatatcctcttgctaagctgtcacccgacacacacaattctcccgctaaaccaataggcacaagattgttgttgtgatcaattatgaaggctttcagatttctgatcggcttaccgataggaatggtctttgccatcgccctctcagcttctgagtatctccacattgtagagcagattgtcgtttcagttggaccgtaggcattaatatagtctattttattcacgatccggttcaaggattttgtagatatctgagaaccagcagtaattaagagccttaaagctgataatccgtttatatttatatggttgatgtatacaggcggcaaagtggctacagtaatgtcatgccggttaatatactcttcaaataatgtataattattgatgacttgacttgaaaggatgtgtagttccgctccggtcaacagtgccatactgatttcccacactgatgcatcaaatgaaaaacttgcaaattgaataattttatcccggtaattgatattcatatcatgttcaaagacacttttgagattactgattccgatatgccggatcgttacaccctttggttttccagtcgttccagaagtataaatgacataagcaagatgttctgcggaactcatcattggcaggttatgccgatctccggtgtaaagagaactatctgttaaatcaataaccttcccgtcaaacggaatattgtcagcctgactattctgcactaataaaatgtcagaaccgctgtcttcaatcatgtatttgattctctcagaaggatatcccggatcaattggcaaaaatgcgcctcccgccttcagcacacccaatatgcctaacaccatctctaatgatttgtcagcaacaatacctactattgactcttttttcacccccattttcattagtattctcgccagactatttgatctttcgttaagttctttataagttactttattattttcatacactgccgctattctttccggtgtcttttccgcttgttcttcaaacaattgatggattgtcttattatgcgggaagtcggctgctgtatcattgaatacataaagcagtttatgtttctcatcatccgttatcatattcagtctgcagattgccgtgtccggttctgatacaacctgttgtaaaagccgggtataatgagcacccattctttcgactgtgtctttcctgaataaatgattgcaatattccaattggaagttaacgccttcatcggtttccattgcagttaacgttaaatcaaatcttgatatattgacctcagataccagtaaatttgattctgctgtctcttcatttcctccgaatccgtaatccttactctcaaaagtaaacatgacatcaaacagcgggttccggctcgaatctctttttaccccgagtttttgaacaatattttcaaattggtaatctgtattctcaaaatcttttaacgtatgatgtttgacctcttctaaaaacgctctgaatgttttatgttcctcaggaaaatttcttatggcgacggtattgacgaacatccccaccgtattctccagttcggtgtctgaccttccggactctgccgttccgatgatcacatcctgctgaccgctgtattttgaaagcatgatattatataccgccagcagcaccatgtacaaagttgttcctgtttctttcgccaccgactttaagcttgatgttaacctttcatcggccgtaaagctgactcggcttccttcaaagcttttgactctcggccgctcgtaatcagtctgcagattgagaatcggcagatctccgcttaaccgcttaagccaatactcctcttgttcctttaacgcctcttttgttcctgagcttacttgccattctgaataatctttatattgcagcggcggctgttttagtttatgatccgcatacagcgcattgaattctttgcggattattccaaccgatacaccgtccgcagcgatatgatgaacatctaacagcagcagattccggtcttcatacgttatgagtccggctctgattaacggtgctttgtccaaatgaaagggtctgataaactgcttcacatatggtcgtatcccatcagacggcagcttctgataatcaaattcgagctcccatgtatcgtgaataatctgaaccacatcgccgtttacaacatcgaaacttgtccgtaaagcttcgtgtctgccaataatctcttgtagaactgattcggctttttttacatctaattttccgtttagttcaatcataatcggcaagttataaacgatactgtctttatccgtctcccaaagggcaaacattcttttctgagcagatgacgcttgataagaagactgctttctcgctttactgatgaccggataattctgtttatcccgcttttgaataagacggctcaactgtttgatggtaggctgctcaaaaagctccttcacctttatatccgtgccgaatgtttttctgatgcgggaaattaacatagaagcctttaatgaatgaccgccgatttcaaagaaattttcatctataccgacgcgttccctgccaagtacagcttcccaaatctccgaaagttttttctccgtttcatttgtcggcgcttcatattttgtttcggacatttgagatatatcaggtcgaggaagtgcccgtctgtcaattttcccatttaccgtcaaaggcatgttatccatttgtttaaagtacgatggaaccatatattccggaagaaagtctctcagaaagtgctgcaattcaatctttgcgattttatgatttgaagtgtaataagcacagatatataaatcatcatcaccattatgatttactgttactgccgcttctttaatttctgtatgattgatcaatcgggcttctatctccccaagctcgattctaaaaccgcggattttgacttgctcgtcccgccgtccgataaactccacatcgccattttctaaataacgcactaagtctcctgttttataaagacgtgctgaaggatcattattgaaagggtgtgatataaaccgttccttcgttaaatcaggccgtcgccaatactctcgcgccagcccatctccgccaataaacagctcaccaggaataccaggcgctaccggttttaattgcgaatctaaaatgaatatttctgtaccagaaataggcctccctataggaagcgtactgcctttccaatcatgagggaccgggaaacaacaggtaaaggtcgttccctctgtcggcccatatccgttaattacttgtacctttccaagtgctaatactttttgaacatgcggaacggaaaccacatctccgcctaccaataattgctgaagcccttttaatgattctaactgctgatcaactactagagaaaataaaccggccgtcagccaaagagtcgtaatgttatatttttttacagcttctgcaatatcatcagccgtcggtattcccggaggcattatagccagacatcccccattcaataaacagccccagatctcgaaggtagaagcgtcaaaagcggcagaagctaattgcagaaacgtttgattctcatcaaataccgcataatcagtctccttcaccagccgaatcacaccgcggttaacaatacttactcctttaggcagtcccgttgagcctgacgtatacatgacataagccaggtcatccaaggaaccttttatgccaatattagatccatccatcttttcaatttcttctttcataccatccaaacagattacgccgtccccgtgaggcgggagttgtgactgaatgctttcgtttgtaatcagcaactctacacctgaatcttcgattaagaatgatagtctttgcttcggatattgagggtctaacggcacataagcaccgcctgactttaatattgccagaatactaatatacaaatcaaaagagcgttctaaagcaattccgacaaggtctccccgttttactccgcactcctgaagataccgtgccagctggttcgcacggtgattaagttctgcgtaacacattgaagagttttctagtaccaaagcagtcttatccgaatattcatcagcctgctgctcaaacacctccgaaattgttccaattttcgaataattatcttcccagccaaagattttcttttgcttatttttttctttcaggaatctcatatctttcactctgatattttcaggagttatcatagcttcaaggatcatctgaaatcgcagtgacaaatcttttatcatattttgagaatagaggcattcgttatagtgtatggctgtctctatgtattgtttctggtttataaacgaaaataggatatgaatagcgggattttcttgattaagtatgtattcttgaatattttcaaggactatcatgacatcaaaaggaaggccagtcattttatcacttgttcgagaattattttgggggctttccaatgcctgttctacggtgaattcgactttatgtatgatctcttttaataggtcttcaccatgaacagcatttttaagagtcaaaatttcttgctcagaatcaatcgttctgttctttctgaaaacaggagtcttgattacaatattttgtctttctgtatattgatttattaacaaagtcagtgccgctgttaatacgacatgcagacgttcatccgatccattgcagcatacattcagcttatcgcttaattgctgtgacaatttatatgtaagatttttcattcttttttctttagaagatttacttcccactaaaaaatgctcttcagtttttaactcaccaatactgtttttatctccctttatactttttgtcataacaaaaactccttcacttgatatcaaaattcaattcattcactgaattaaaacagcagaggctttcggtggatttttatgttaaactgcatcacaggcaataacgctcaccaataattgttgttgtagtctgacagtttatttatcggcagcaaaaaccattttttaatgatatagacccgtataaacactttttttaaaaaaaggataatgaagaagaactagccatctttaagaaatattatacaaatatttaagagttgtcaattagcagggaaaaacacctaagcacattaacccagtttttatttttcgtattaacataaaaaaaccgggacaaagtaacactcccgatttttcaatcaacaatttatctcaaggttttatttataatgtcagttatttcattcgaaaattgatgaataaaaaagtgatttccttcaaacgtataaaaattgcatttccctaaagtataatgtccccaattacatattaaatctgagcttatcgtcttgtcattaataccatgcaacactgttatatcacagtccataacagtcttattttcagaaataacatccttttctaacattttgaaatcacttcttaaaataggaagatataattgttgtaattccttgttatgtaacagttcttccgaagtcccgcccatatccatgattctttgcaaaaataaattatccggcaaagcatgaatcatcccctctgcttttttcgttttaggaatgccgcatccggaaaaaaatatgtgattgggcttcttctgctgcatttcagcaattttacaatataacttataaactaatcggcctcccatactgtggccgaataaagcataatcacactccctgatttgatcctttatcagatcatatatatcattaacagcctcatctatatgttcataaaaatcttcgttaattcttgtacctcttccttttaactcaataggatgtattgttaaagagtcactcattaaccttctccatttatagtatattgcacttgatccccctgcatacggaagacaaaatatttttttcataattcacctcagaaattttgtaataacccgataaaaaaacaccctgaaaaggatgtttttactatctcattttatatatgaaatgctcttgaaactccgttgatgatgaggaagattcctattactcttaaaatgatccttgttgttctgttatcttttccaaaagcaacttgcccgattttaccgataaatacattcatgagtacacctataattaattcagccattccaaatagttcttccatacccaatttcctcacgtcctttttgatctgttaattttatccgattattgttgatttaattttcttttttaatctccctgcttatcaagatgaaagatacaataatacttaataagccgacacttgcaaaaattacgatcggaagccattcagttcctaaggtactcttactaaagataatgttgtttaaagactgtattgcccatgcttcgggtgtaaatttagaaataacctgcatatattttggagcaatttccaatgagaaaaaggaaccgcctatcatcccgcttactgcaattatgatcgatgcggcagaagtaaactgcttttggcttctcataaatggaaccataatcatcgtaatgcaggtcaatgcaaataaataaacagcgagcataacagcgatggcaaagatgttatgacctatgctgatcttgagtaagtattttcccgcaagtattataacgattatatgaatgattccggaaatataagtagcagccattttggataaaacatattttgtatagtttataggcgtacttagtaatcggctgaaagtattattctctttttcatcaataagtgttcttaacccttgaataacaacaaaccaaataaacattacaagaaaaccaattaatctcacggtcgcattatcctgagtatgtttaccctggcttaatgttttgtcattcacttctattcctgaattgtttttcaatttcttgaaaatgttcttttctatatcttttgagtccgtatgcaactgcgcagacatatattgcgaatctttaactacctttttaagagttcccgcctcatttttgaccagctgctctaacaatgttccgctgccgttctcatagttttggatgattttcatttttatcttgtgattgtccgccaattcctttccaaaacctttttcaataacgaccccaaaaggaatatcctgatcatcgacttttttctttatttcattttccgttagctttataactttaatatttttatgctcttttatcatttcaatgagctttgcagcatagttgcttttatcagcattggctatatacaagttctctttgctatccgtatcttgggaaaaagagaacaaaaatgtaaggattaacggcactgaaatagttgcaaaaattgctaatctatttcggagcatcagcttcagctgatgtttaatcatggcaatcaattgcactactacgccaccttcttcctgttgaataccataatattaataaagacaaagatgagaccaataccaattagctcaagcaaatcaatatacatgccgctaaggccaatattctgtttgacttttaaataagagtttattgccttaccgttcggtatgatctcttggacaaccctcaagctatcaggcagtccgttcttaggaataaaactgcctcccaaaaaactaaaaatataaagaaccggagaagccatactggacaccgccacgtggtccttagcggtaaaaccccaaaacaatacaatgctgcctatagcaaatgcgtatactaccgtaataacaaaaatatcaaacaagttgccccagttcattcggaatacgacccagcttatcagaataacagcagtcatctgcattaagatcgcaaaaataatacctgtcaactttccaagcacatactgaatatttaaagtcggtgtagatttaattctgaacagcgtattattctgccgctcatcaacaatgctatgaacaagcacaaaagccgtcataatggaaaacataacaaccattgcaattgaataatactgcatggaatcgacaggaaccgcatttttatttgtcgctgcttttgggatatcagcggagatcccgtcattatcggccaaatcgttcatcattttttctattttttcttttggtacgctgccgccggggctgatatgttttattacttcttgttgctcagcactcattgttttcacgcttttcgtaaagccctccaaaacagcctgaacaatatttttatctatggtcttattattatctccaattaaatcgatatttgttttcccgttgttcataacggctttcgtaaagtgttccggtacatagataaaagctgcagcctttccttctttaactaatttttcaccgtcattgtagctctcagcttcttttaaatgaatgatatctttgagatctcctttcttaaaaactttatcctttaagacatcacctaaagaaacactctctcctgaatctgctgagtaaaaagctacatcaaatgcttcgatttttgaatctgaattactgaacacactgcccaatatgaggattagcagtgatggaaacagcatcagctttaaataaaatgacttattttttgttaacagcttaaaatcaagaaaaaataagttgaataattttctcaagatagcctcctcctactaatctcttaggtttttccctgtaatttgaaggaaaatgctttccaaatttacttcctcgtacttaaagctagtgaggtcgatccccagatttttgatatcatctacaatttcaatgatgtttctttccttcgtcgatacaagcattgaaatttgtttatgatctaccgtcactttatcaattcctgtaatgctgtttatccggctgagtgcctcttcatcagcacccttaaaagtaacagttaaagtgtcacaagcatttaagttttccttgagttcttctttcgttcctaaagcaataagagatccatgatcaacaattgccaccttctcgcaaagatactctacttcttccatatagtggctggtataaataacagtcattcctttttctttattcagcctttttactgtttcaagaatatgatttcttgattgcggatcaattcctacagtaggctcatcaagaattaataatttaggattattcattaacgccacgcctatgttgacccggcgtttcattcccccggaaaactctgatacattttgattttttttatctgtcagttcaataatctccagaacctcatcagttctttcttttagctttttccctttcagcccgtaaaggcttccgaagaagttcaagttatctttggcgcttaacgtttcatataaagctaaatcctgtggaacaacccccattattttttttatctcaataggtttttccttaagtgatttattatctactttaattgtcccgctggtaggtgcaagaacagtgctaatcatagaaaccattgttgatttgccggcaccgttaggacccaatagtccgaatacttctccatcttctacagtcagcgaaatattattaactgccgtaaagtcatcatattttttggtaagtttttttaattcaagcataattaaaacacccctcgtggtatttcggttcttttattttaacctgaatggaatatttttagaatttactatagtactcatttaccttattactttagttacgaatcgcatcgttactttagtcatatacggaaggtgtaagtccggatatattcagaagaaaatggaggaaaggaatttgatgaaattcctttctgattgaaggaaaaaagttgaatcacatatgcttttgtaaatataagctaagctccgttcggttgttcatttgaagtttttccagtattcttgatacataatttttgactgtgccttcagtaataaacagtgcttcgcttatagctttgttgcttttcccttccataatctgtttagcgacttctttttctctgggagtaagcaattgcaccagctgttccttttcattattttcttgaacaagctctttattatgttctaccgaatttagagcctttacaacttttagcgttaccttaggatttaacagaatattgccttcacatgctgttttgatggaatcaataatttcttgtgaatcagaatctttcagtatgtaaccatcagcaccgcttttcagtccagtaaaaatgtattcactatcgttaaaggttgtcaggataatcactttaatatccggatatctctctttaactagctttgttgcttcaatgccgtccattacgggcattcttatatccattaaaatgatttcaggccttatctgttttagcaaatctaataaatgttcaccattagaagcttcgcctacaatattaatttcctcgtgcagactcagaatcattttaagcccttccctgacaatttgctgatcatccacaatgataatatccatatcaatacctcctcacattccgattaaagatctgctatctcggggattacggcttccacagtaaatcctgaatctagccctgaataaaaatcaacctctcctccaagtgcggcaaatcttttttctattccgtttattccatttgacttattaatttcagaacatcctgttccgttatcagttatcgatatagagattttttcaaaagacttacgtatttttattgaaaaaaacgtagcatttccatgttttatcccgttggttatagactcttgtactgttttatagagacaattcttgatatctggatcagctgactctactttattgtccatatcaagctcgaattttatttcatttgtttgctgaaaattttcaaaaatctcattgatcgatttcagaagccctttttgaggagcagggtcattgagcaaagcgacagcttctctcaggttaataatacactccttcgataaatcatgtgacttattgatgacttgtttagcctcgccgggatttttacttactattttatcggcgaattcaagattcattgttaatgcgatcaaataatgccccagggaatcatgaagctcttgtgcaattcttgtccgctctttagaaatagttaactcttgaattttttgagaataattcttaagtttagtgtttacactttgtaattctttatttaatgtttgtatttttgctttttcgagcagtacgtttctaaacagataaataatagccatgatcactaaataggacatcaatatatctttcccgctggtccctgctgctttaagagctgtaaaaaaaataataaaatgcagacttactacagtccagggcagtttacgagttgttacaataatctcgatcagtaaaaaaatattatatatttgagaaccgagacagttaattttaaacaataaaatgcctgataaaaggttacttactaaaaaagatgcataatatctaaaagaatactgaccgcttaggtattttaatctgatatgatcgttgacgactaaaaaaatggtgataatcagcaggtaagcggattccgaagccgtaaaagttggcgttttaaaaatagaactgataatagaatataaggaaaaacaaataatggttttctctatgagcactcttgtactaattgaagaaagatttttcataataatccttcccgagacaacttgatataaattatattatacatatattgagaaatcataaagcgacaacctccacgttcagcacatcatacagctcatcaagcgaatgaatttcatacgtcgggataatcccggactcatttgctttctttccgggattaaaccagcacgtatccattcccgccatctgaccgccttttatgtccgcgctcaatgaatcgccgataataagcccgtgcccggcagaaaaaccgggaattctcgcaaatacataatcaaagtattccttcatcggcttttgaaaacccgtgtcctcagatacaaacacatctttaaaaaacggatacagaccggagtcgcccagccgcttatattgtgatcttgagacgccgttcgtcacgatgtataaatcaaataaaggactcagccgttcaatcagctcataagctccgtctatcatctggtgcccttcttctaagtattggcggtacgcctgattcatcagcacgccgtcggcttcaaggccgtattctttaaacaaaagggcaaaccgtgtattcaccacttcatcgcgggtcatttccccctcttcaaacgccttccacagcccttgatttaacgctttataacgggcttccacctctgccgtcagctccagctttgaaccttggaacaatttttgaagagcatcggtttctgaagcggtaaaatccagcagcgtattgtctatatcaaataataacgtacggtaatgactcatcgatgtttcccccggttctgctttttttaaccagtataccactcgcggacaagccgaaaaagacacccctgtaagagaggtgtctttttgaattatacagcgtcttctattttcgatttttcaccaggcatgcgcttgccgataccgaacgcataatagctgaccgtcacaatcgccaggaaaatcaccccgacaaccaaagaaatccgcgtatctttgttaaaccacatgccgatcaataccatgagtaagaaagcgatcgtcaaatagtttgtaaacggcgcaaaaggcattttaaacggatgcttatcaagctcagcgcctttcgctcttctgaaaccgagatggctgatcaaaatgacgaaccacggaatcattcccggcagcacactcgcgctgtacacataaacaaagattttcggaggcgcgatgtagttcagcacgacaccgatcacaagtccgattaataccgcaagcgtaccgaatatcggcacaccgctcgaagaaactttcttaaagaatttcggtgcctgtccgttcacgcctaacgtataaagcatacgtcccgcactgaatatcccgctgttgcatccggacatcgcagcggtaatcaccacaaagttaatcagaccggccgccgccgtaatcccgactttcgcaaatgtcgaaacaaacggactgccgagtgagtgaagctcattccacggatatacggtaacgattacgaaaatcgcaccgatgtagaaaattaaaatccgccagataatactctgaatcgcgcttcgcagcgttttttgcgggtccttcgcttcccctgccgtaattccgatcagctcgaccccttgataggccgcaacaaccaaagacaaagcaaagaaaaatcctgaaaaaccatttgtaaagaaaccgccgtgcgaccataaattagataatccgatcgcatgccctccgttaccgaaaccgaagaaaataattccgattccggccacaatcatcagaataatggtgacgattttgatcatggcaaaccaaaattcaaactcaccgaaagattttactgaaattaaattcgccgcaccgagaatggccatggcgataatgccgggaatccatgccggcagatcaggaaaccaatatttcatatacgaaccgacggcgataatttcagacatcccgacgatcacccattgaaaccagttgctccacgccgtcatatagccggctaacggatgtatatacttatggccgaatgtcgcaaacgaccctgtactcggctctacatagagcatttcgcccatcgcacgcatgataaaaaagataaagatacccgagatcgcataagccagcaggacagacggcccggtccatccgatcgtgctggatgaccccatgaataaaccgacaccgatcgtgccgcccagcgcaatcatctgtatatgacgagcgcctaagcctctctttaattctttgtttgccacttcgcttcctcctcttaacagctctgatatatgtgaaataatgaagcagaaggtgcacctgttgaacctaactcactcttcatttcccgcaatattggaaatattctatcttcctatcgttatataatctccaatttccttattccatcataataaattttcgtggaaaatacaattgtttttttcaggcaaacaccttacactctgaaccaacggactaaaaataaagcgctttcatttttattgaattgtgaatattgagataataaatgccgcagcctccgagaaacattatttcccaggagaaacgttttccgccccctatccaatattatttttgctaagcagaatggcgtaaagccttactctcttccattctcccttgtatacgccataatcctgcttaacccggcaaaaatcatgcattaatcgataaatgcctcattcagccgcagcaaaagccggccgaacatttctttttcatcgccggaccaatcgtcaagcatacgatgataccgctcaagacgcatctttttatcagcttttaacctctgtttgccaagcttcgtaatcgcaaacagactgacccgcccgtcagaaggatcggaaaaacgctggatcagctctttcgactccaaggccgctgcctggcgtgataatgtggaaatatccagcttaaatgattcggccaattccttcacacgcgccggcccgaattcatccagctgccgtaataacaaatacgcagccctttccagatgtccgattttacggtcggagttatcaagataaacagctctcctgatgaaagtggtgagttcatattcaattaattcaatcggatcttgttttgacaaacgcctcactccttacattgacaacagcaacattagttgtataatacaaacatatgcacatttactcagaaaacatatagaaagattttgcatacatatatttgtatagtacaaatatatgtgccaaaagtaaagaaacttatagaaacatcaagaaagggggaagctgctcttctccaaagaacagcatcgttgtgaaagtcatacgcatcatcttgcaaatcattattttattcgcattttcctttatcgggggagccgttcagcagttctttcacctgcccattcccggaagcatcatcggtttgatcctgctgatcatatgtttatcggttaagatcattcccgtcaaaatgattgaagacggagccggatttttgctgtcttttcttccgctgttattcattccggccatgacgggcgtcatcaattacccgtcactgttttccgccagcggggctgctctgtttctgatcatcgtgctgagcaccatcgtcacaatgatcgccgcagggtacgccagccagctgttagagcataaagccaatcagagaaaggagaaaaagaagtgcagcaagcatgtatcgcaatccttataattttgttcacggccgccgcctatctggctatggtgaaattatatgtgcgctttccatacccctttctcataccggttttgacgactacgattttcattatcgccgtgctgcttgtttttcatattccgtataaagactatatgatcggcggacaatggatcaattcactgctcggccccgctgtggtggctttggcatacccgctttataagcagcgccgggtgttaatcaagtatatgtttccgatcatcggcggcgtgttggccggtttattctccggaatggtcagcggcctgctatttgcagagctgttcggcatcagccggagtttgattttgtcaattatcccaaaatcaattacgacgcctgtcgccatacagattgcgtccggtatcggcggtgtcccttccatgacagtcgtgttcgtcatgatcgcagggttttccggcgttatcttaggaccgctgcttctcaagtggatccgcatccgcagctcactcgggaaaggaattgcattcgggagcgcctcccatgcgctcggcacctcaaaagcaatggagtacggagaattaacggtctccatgagttctgtttccatgacgctctgcgccgtgttagggtcggtcttcggccccgtcgtagcatggatgtttcaaatttaaagccggcggttctccgtcagcttttttcatgtgcggatcatctcatttccttccattattatgtttcatttgtaagaataatggtaaagtagaaaacaaggagggatttaatgatgactggggcaattccgcaaaagaaactgcttgatgggacaagcattcccgcgatcggcttcggtacatacgctcttaatggaaacaatggcgttcatgccattaccagcgccattgatatcggctaccgtctgattgacaccgcttataactatgaaaatgaagggacggtcggagaagccatccgcagaagctctgttccgagagaacagctatacgtgacgtccaagctgcccgggcgctaccatgactatgacaaagctgtacaaaccatccaagaatctttataccgcgccggtctggactactatgacctgtatctcgtccattggccgaatccgaaacaagaccgctacacggaagcatggcaggcactgattgatgcgaaaaaatggggcctgatccgatccatcggcgtctgcaatttcctgcctgagcacatcgaacggctcgaacgtgaaaccggtgtaaagccaggcatcaaccaaattgaactgcatcccgcttttaatcagcagcagcagcgccaatggcacgaagaacagggcatcgtgacagaatcatggagtccgttatcccgcgccggcgaagtattgaacgatcaaaaactcggacagattgcggacaaatacggcaaaaccatttctcaagtcattttgcgctggcatatccagctgggcgccatcccgattccaaaatcagcatcgcccgagcgccagcttgaaaacatctctgtttttgatttctcccttgatgaaaacgacatgagcatcatcgactcgcttacccgccccgacggacggataaacggccaagacccggcggagtatgaggagttttaaaaaaacacataaagaaaagctgacggcatcatttgtcagctttttcaccttttactctgggatagccaagactgtgaaactttgcagtaaaggctggaaacacacttatcctattataaattgatcagctgctaaaattcttttttatgatatatagctgcggcgatgaaaaatgaaatgatatataagataacgccgatcatgagatatataatcgggacatataaagaaggatttatgtgcaaaaatgacagcggtacttgttctgctgcatacccaacgacactttgcaatccaaaggtagcaaaaagtccccccattgcccctccaatcacgatagcatcggatttttccgggcctatcatgtagagaagaggataaacgattgcaccggcaaagagaacgatgaacgttccaaaagagacaatattaaatataccgtcaattggttcatcagaacccaggctgtatacaaggaaaataccataagatattacagctccgatcacaacaatcaaaagataaaagaaatagtgactttgaacaatatttgttctgctgaccggtaaagtcagaacatacctgtcatagcctgacttgctctcatactttataacctcaagtgcgggcataacgacaaacaaaataatcagcatagcaacaaaacgatgcattgaagcatccccaaaataaaaaatgactgctgataccaatatggccaaccccgtgtatgcaaagaaactccgataaaccaagtaatagttagtcagtaacagacctctcaatgttttcactcctcgttaaaaagacgctgatttcttctatggaaatggtgttggccgttacgccattcggcaatttctgttgatccgatacaagcacactccaataagatccatgattcctttttgctagaacgatatcttcgtcaatctcagccaattgaccttcatcaacgtctataacggtatagctttcaagaaccttatctttctcttcatttaataaaatttcgccatctttcatcataatgatatggctggctatcttctcgacatcagtcataatgtgcgatgaaagtaaaatacctccgttgcttttactcacaaagctttttaattcatttaacagatcatctcttgaagagggatcaagccctcccgttgcttcatccagaagtaataattttgcattatgcgacaaagcaacagctacagataacttcattgacatgccgcgcgagaatgtattcacttttttatccataggtaaagagaaagaatgaaccaaccggtaaaattgatcttggtcccaagcgtcgaacagtttcttaaatacatgattcagctgctttatcgtaaggtgcgcgggaagattcatcgcatcaaatacgaccccaatatcttctttaaactttatatgtttatccagattctctttaccaaagattttcactttacctctatcctgagagattaatcctaatatcgttttaaatgttgttgacttgcctgcgccgttatcaccgataaaaccgacaattgatccggcaggcacattgaatgtaacatcctttaaaacagctttatgaccaaaagatttgctgatgtttctgatttctaaaaggtttgacatcattccactcctatcattgttgtcaggacttttttaagaattgaaccggattattgtaaaaatgttgtgattttcatatctggtctaggtattcataatggatcaggagtcgggaaatacaaaagggattttaaagtcttaagcataatatggaagtgtaatcgattgattaggtttatataatgggatattcatgatgaaaactgctgaggtgtttactttccgatgaggtatacacaaaatgatttactaatgattacatttatggattttaaccggaatgcatctcgtattataaagcaggtgttactccttttcaatatataaaaggggatttctttacaatcgcaaagagtatgcatttctcatttccgcattaaaaaacccctctggctaataaccaaaggggttaaatatattattccacagtcacgctcttcgcaaggttgcgcggtttatcaacgtcacagccgcggtgcagtgccgcatagtaagcgatcagctgcaatggcacaacagaaaccagcggagcaagcgcagggttgacttccggcaggatgaatctgtcgtctgcgtcttctaagcctttcagcgagatgatgcaagtgttggcgccgcgggccgcgacttccttcacgtttccgcggatgctcaggttgacgtgttcttgtgtcgcaagcgcaaagaccggtgttccttcttcaatcagagcgattgttccatgcttcagctcgccgccggcgaagccttccgcctggatgtaagaaatctctttcagcttcagggcgccttcgacacacacgaagtagtcaaggccgcggccgatgaagaaagcgtttcttgaaacagtcaggtactcacgcgcgatcatttccatttcgtccttctggtcgcagagggcttccatggcgtttgccgcaatacctaattctttgaccaaatcaaaaccgatatcaacgccgttgcgttctgctgcaacggacgcaacgatcgcgaggacggcaatctgagccgtatacgcttttgttgatgcaaccgcgatctcaggacctgcgtgcagaagcaatgtgtaatccgcttcacgggaaagcgttgatcccggaacgtttgtaatcgtcagcgctttgtgacccagcgctttgacttgaacaagcacggcgcggctgtccgctgtttctccgctttgagaaaggaagataaagagcggcttcttagacagaagcggcatgttgtaagagaattcactcgctacatgcacttcaaccggtacgtttgcccacatttcaatatattgtttcccgacaagaccggcgtgatagctcgttccgcaagccacgatataaatgcggtccgcttccgccacggcgtcagcgacatcgcccgccacggccagtctgccgttttcgtcctgatacgtttggatgattttgcgcataacaagcggctgctcatccgtttcttttaacatgtagtgagggtatgtgcctttttcgatatcactggcgtcaagctcagcgatataagacgcacgtgtcatgacttcaccgtcaagatttttaatcacggcttcgtcttttgtcacgatcaccatttctttgtccaaaagctcaacgtattcattcgttacttgaagcatagccatcgcgtcagatgccacgacgttaaacgtatctccaaggccgattaacagagggcttttgttttttgcaacgtaaatggtgtctgtgttttcaccgtcaaataatgcaattgcgtaagagccttttaacagagtcagtgttttgcggaacgcttcttctgtgctgagtcctcccgccacaaattgctcgatcatttgaacgactacttcagtgtccgtgtcgcttttcagttcaacgttttcaagatactcgcgcttcagctgaacatagttctcgatcacaccgttatgaacaagtgtaaagcggccgagtgcgctttgatgcgggtgagcgttcaggaagcttggttcgccgtgagtcgcccagcgtgtatggccgattcccgcttgagattcaaccgtgtggtccaccacttcacgaaggtcggcgatgcggcctttttctttgtacacatgcacgccctgctcattcgccacagcgataccggcagagtcatagccgcggtactcaagcttctctaatccttttaacaaaatctctttcgcatcaagctgaccgatgtaacctacaattccacacatattttcttcctcctaaaggtgtaaaaggagacgaagaaagtcaaattacaaggggactttcaatcgtcccctcccacatgtttttttggaagatcatgtgatttccctttgttcggagagtcgcccctccggtttgaagaaatccttacggctgtgatctaaatgaatcagccgggaggcatccgccgaaaattcgataacctccatcctcgtcaactaagccgtttttcgggcgcttagttcgggcgctgtaattataaaagatgcaaacaatcccgcctttcctgcaagtgaaaaacaaaggctgaacaagcttgattttacagcatgtgccaaggacggtcaattattttttgccgccccggcatcatgtttactatcattttatgctgatcgcacttgtcttgttcgctctctgcttataaacttcgctactccgctcccatttctgtccgcacgacatccacgatttttgtgacatattcgtcacaaagctcttttgttctcgcttccgccatcacgcgtacgagcggttcggtgcctgacgggcgcactaaaatccggccgtctccgttcatttctttttccacttcagaaatcacggccttcaccttagcgttttcttctaccttatatttatccgtcactttcacgttcactaagagctgcgggaattttttcatttcatccgcaagttctgaaagggttttgccggacgccttcagcgtattcacaagcatgatcgcggacaaaagaccgtcgccggtagtgttgtaatcaaggaaaataaggtgccctgactgctcgccgccgacattatagccgtcttttttcatcgcttctacgacatagcgatcgccgactgccgtttgaacgcttttgatttcttctttttcaagcgctttgtagaaaccgaggttgctcatcacggtcgatacgacggtatcatccttcagacggccttctgatttcaaatacttcgcgcatatgtacatgatctgatcgccgtcgacgatgtttcctttttcatcaacggcaatgaggcggtcgccgtctccgtcaaacgcaaggccgatatcggcgtttttttctttgacgaaagcactcagcgcttccgggtgtgtagaaccgacgccatcattaatgtttaatccgttcggagacgtccccattgtagatacgtcagcatcgagatcggcaaaaaggtgcgtcgcaatggaagatgtcgcaccatgggcgcagtcaagcgctacatgaatgcctgtaaaatcttcgtccgccgtctgttttaaaaattgcagatacttttgaacgccttcaaaataatcgttcacaagcccgaggtccgcgcctgtcggtctcggcagcttatcttccggttcctccatgagacgttcaatctcggcctcctgctcatcagaaagcttaaagccgtcccctccgaaaaatttaattccgttatcctgtacggggttgtgagaagcggagatcatgacgcccgcctcagcatccatggctttcgttaaataggatacccccggcgtagaaataacgccgaggcgcatcacttcagctccgatcgataaaagtccggcgacaagggctccctccagcatatgtccggagatacgtgtatcacggccgatcagcactttcgggcgctgcttatctttggtcaggacataaccgccaaaacgccccactttaaaggccagctctggcgtaagctcgctgttggcaacacctcttacaccatctgttccaaaatacttgcccattttgtatcgctcctttttcattctgttgaagaagaatcagcgcttgatccgtcttcatcctggtcttgattttgatcctggttttgacttttattctgatcgctgtcagtgtcgtcttcccggttcttgttcttgtctttgtctgcgtctccgcttgtgccgttcttattgccggaatcagcggagccgccgtcatttttatttgaacttgtgtttttcttagaagtcagcttgatcttaaccgtgtcttttgacagggaccatgtgacgttttgcgggccgtttacttcaagctttacagagtgctctccgtcatccaagtccgagacattggcatacagttcaatgtccgactttttcagcgccttaatgttggcgggagagcctttggccgtaatatttatcgcctgcgattcagggtcgagaaactcaatctgctgtgagcctcccagtccgaccgtcttgattgcgacattgtcaaaatcctttttgtcttcactgtccactttaacatgaagcgtgattttttccggtgataccttagtgacacccttaggaagcgggatatcggcattgatatcggtatctttatcaattttgcctaaatcaagagatacgccgtcaataaattcaagtgaatccagcacatcctgcgggccgtaaaccgtcacctcactcggattcgagtcaatgctcgcaacgctcaccccgtccggaagacttcccttcctttcgattttgaaaggaagctttttgctcggactggctacgggaaccgtcactttaatgactgacggttcaacatcaacaggaagtgcgttgccgtctttgtcatagacggtcaccttcacttccttttcaatggtctcatttgcattttcaaggttcacagatgctttgacaagtgaaatgttatcaatcacatttttcgaacctgtaatctgcacgtttttcgggctgataatcggctgctgaggggtatatccctttttcattttgcttttattgtagtattcaacttccacgggaaaactctcagccgttttttcctgaatcgtaaccgtcgtgactgacgggtttatggagatcgtcagtccgtccgatacgtttttcgccttcaattcgaccttatgagtcccggtcttcagcttattcatatcggcgtatatctcaaaattcttcgtctgtctcgcctttttcaccgcgcttgtcgagcctttaatcgtgacatttaccgtctggggcacgccggtgacgacatagttcgcttcatcgtagtatgcttttacaggaatatcagtaagcgtagcctcgtcagtcgttgatgtcggaaaaaaggattcccccggctttttcggagtcggcgcctggttgttgttaaccgcaacgtaaagcagcagcgccaagagcaatgcaatgatctttacagcccagcggttgtttaagaatttatccatttttcttgcccctccagtaccagcggttagaagaagtgtctctggcgttcttcttaaactcggcttcaagcatttctttcagtgcttcttccgtcaattctctgtgaaggtctccgtttctggccacactgatggcgcccgtctcttcagatacaataatggttaagctgtccgtcacttcactgatgccgacagccgctctgtgacgcgtccccagctcctttgaaataaacgggctttcagaaagcggcagataacaggcagccgcagcaatctcgttatttttcataatgaccgctccatcatgcagcggtgtattcgggatgaagatattaatcaaaagctccgagctgacctgcgcattaagcgggatgcccgtctcaatataatcgcccattcccgtatcgcgctcaatggcgatgagtgcgccgatgcggcgtttcgccatgtagctgatcgattttgtaatcgcttcaattgtcttatgctgcgcttcctccacaggggttccgctcctggaaaagaaccggccccgtccgagctgttcaagcgcccgtctcagctcaggctggaatataatgatgatcgctaaaaatccccatgttatcgcttggtccatcagccactgaagcgtgctgagtcccaaatatgaactggccatccggaccaatacgatgacgacgattccttttaaaagctgaaccgccttcgtcccgcgtatgaccatgattaatttatatatcacataccaaacaaggagaatatcaacggcattgccgaggtattgcaaaaatgggatgtcctcaaaagccatttcctcgtcctccaagaattcagtcatttcgttttttccgttatgaattgtgctgcatgagcaatatgtacatcatatagcgtgctcattataccacattttgatttctcaagtgaaatgagccggcgcggcgttgcacaaaaaaagagtaaagcgattatacgctttactcatcttcattcgggtccaaagcgcttacgacgccctgtcccgccgatttcagttcgtaccagacccagtcaaacaattggttaatctcttcaatctgcccggtgacttgtccggctgaggccatgtatttttctccgttgacgacggtcacattgccgtcgacttttccttcaatgaacagcttgccgttttttactgtgacatcgccctttacggtctcgccttcagggacggtgaccgtgtgattctgcacgacaaggttcggctgtttggacacactgaaattgtggtcattatgccagctgttgaaaaaaccgccgcccattaaaatcacaaaaaccgctgcggctgcaatcatcggatgagttttgatccatcgttttacagaagcgcgttttttctcttttggaagattcgccataactttggcagtaaaatcagcaggggccgtgacatgcgatgtgcttcggacgagtgctacggatttctccatttcatgaaaatgccgtttgcaattcccgcatgactgcaaatgttgttttaatacgttttcatcttcaggaaggatatctccatcaagatgcttatgcataagctgcacaatctgttcaggacagctcatttcatcaccccacttaaagatccctcaattgttttctaagagcctctctgcctctgtgtatccttgtcttgacggtgccgacagggatattcagaatctccccgatttcaattaaagagagttcgtcaatatactttaatacaataaccgttctgtacttgtcaggcagctttaaaatctttttctgaattgtgtccgacagctccaatgacaatacggcgtcttcagggagaaccccgtccgcggcgatctgcgaatacatcgtcagcccttctgctcccgctacttctgcgtccagatagtaatcaggctttttcttgcggatgcggtcaatggtcaggttggtcgcaattctgtaaagccacgttgaaaactttctgttgatatcgaaactgtcgatattgacatacgctctgataaaagcttcctgcgcaatatcttccgcttcgtgaacattgccgagcatgcggtagcaaagctggtaaatcttatctttataaaggtcaacgatttctgcaaacgcattttgatcgccttttttgacttgcttgattctttttttaatcaggttttccatgttttatcttacctctgcccttcaccggtctgtatctatacgttgattgttttaaaaggtttcatttttttattacatttattttaccaaatttcaggcagggtgtagatggaaaatacagaatatactgccttaacagcagcttaaaaatagtatatctgatgaacaatcaaaaaccgaaacaaaatgccgataaaaaaagacacctttatgcaaaaggtgtctgagactgggctagctggattcgaaccaacgcatgacggagtcaaagtccgttgccttaccgcttggctatagcccaaaaatggtggaggggggcagattcgaactgccgaaccctgagggagcggatttacagtccgccgcgtttagccacttcgctacccctccgtatttttttggaaaacagtgccggccagaggacttgaacccccaacctactgattacaagtcagttgctctaccaattgagctaggccggcaaatatggtggaggatgacgggctcgaaccgccgaccctctgcttgtaaggcagatgctctcccagctgagctaatcctccatatgacccgtacgggattcgaacccgtgttaccgccgtgaaagggcggtgtcttaaccgcttgaccaacgggccgctgtgtccgcgtcgagctgacaaaagttattatatacaggttgtaccccatttgtaaagagaaaaattattttttttattttcaaacttttttacccgttttttaactgaaaaactcatccctcctctcttatttcatttatgatgaaagtatcaaaatattgaagggaatggacacagatgatcttagtcagctcttgtctcggcggtatcgaatgcagatataacggctctcacgccgcttcggaaaaaatccgcagactcgtagaagaaaagaaagctgttatggtctgccccgaacttttgggcggcttcaccactccccgcgaaccggcggaaatcatcggcggcacgggtgaagacgtgctgaacggaacggcaagaatcgtaacggcatcaggcgaagacgttacagctttatatatggacggcgcggaaaaaacgttagcatacgcaaaagaaataggcgccgcaacggtcatccttaaagaaaacagtccgtcctgcggcagcagctttatctatgacggcactttctcaggaaaaaaaatactcggagacggcatcacttccgctcttttaaaacgggcaggctgccgtgttctatcagaagatgaattggatcaattataaaaaaggagagtagatatcatggatgtagccctgtccttttataaaccggagcatgcagacgggctgaacgggtttgtgctgagtgaagaagataaaaagttcacagctctgccgatagatgtcctgccgcaggcgcttgtcatccgggatcgctacccgacagtcattttaaaagaagaccgccccgtcggtttttttattttacatacctcaaaagaaaccattgctccgtattcgaacaatgtgtctgccattttgctgagtgcgctgtcattacatgcgccgcatcagggaaaaggttatgccaaacaagcgatgctgcagctccccgcttttgtcgcaaattactttccttggtgtgatgaaatcgtgcttgctgtaaaccatcgcaatcaacgtgcaaagaacctgtaccggtcttccggttttattgacaaagggcggcgcaggatcggcccgatcggtgaacagcacattctgcatcattttttgtgaaagcgcttgattattcatctcatccctgccgatttttcttgaaacatctattcagaagcccatatacttcaagtattaacgacttgggagggtacaatcatgacagaccggcttaacattcacagattgaccacagaaaccagaaatccgcagaccgcttcaatccatcaggcagacacaatggaaattctccgcatcattaacgaagaggatttcaaagtggctgaagccgttcagcaggtgctgcccgatattcagattgccgttcaattcgcccatcagtccttacggcgaaacggcaggctgatttatgcgggagcgggcacaagcggcagactcggtgtactggatgcggttgaatgcccgcctacatacagcgtaagtcccgacaccgtcatcggtctgatggccggaggggcagacgcctttttgcaagcggctgaaggtatagaagacagcgaggaaaccggcgctctcgatctcaaaacgatcgggcttaccgcagaagacaccgtgatcgccatcgcggcaagcgggcgcacgccgtatgcggccggtgcgctgaaatatgcaaaaacaatcggcgccaaaaccgtcgcgctcacatgcaataaggactccttgatcagcacctttgccgatcacagcatcgaagtcattgtcggccccgaagtgattacagggtcaacacgaatgaaagccgcgacggcacataaaatgattctgaacatgatttccacggccgtgatgattaaaagcggcaaagtgtacgaaaatttaatggtggacgttcatgtcagcaacgaaaaattgaaagaacgcgcaatcggcattatccaaagcatcacgggcgttccgtacgacaaggcaaaagaaacgcttgaggccgcagacagccatgtcaaaacggcaatcgtcatgctgaagacgaattcggacgaaacacacgcgaaggcactgctcaaagaatcagaaggattcattgataaagccattgaacagcacgtttcaagagaaaaagaacgctgatcgttctttggagaaaaatattgtgcttttacgagcccgcgccgttttcatgttcggcgcaggcgcttttaggacgcgtttcaggcatagctccccgggaaaaatcgtacagaaaaaggaggatctccatgagcaaagaggcattttatcagtcactggccaaagatatcctggacaattgcggcggttcatcgaatatttcaggctttacccactgtatgacacgcctgaggattacacctttagatcgggacaaaacggatattgaggcgctgaaacggcttgacggggtaataggcgtcgtcgaagccgaaacactgcagatcattctcggcacgggtgtcgtcaatcatgtcgccgacgctttcgcaaaacttatgccatccggaaaaaacattgatttaaaagaagccgcctcacggaaaaaagccgatctcaacagaaaaaacaccacacccatcaaattgtttctgagaaaaatatcaagcatcttcattccccttattcctgcactcattgcatcaggtttaatcaccggtattacgaaagccgtcattcaggccggctggctcccgaaagaatcccaaatcgcacttattttaacggttatcggttcaggcttgttcgcttacctcggcgtccttgtcggcatcaatgcggcgaaggaattcggcgggacacccgcgatgggcggccttgcgggcatattgatccttaaccctgagatcgccaatatcagtttgttcggagagaatctgctccctggcaggggaggattaatcggcgttcttttcgctgcggtttttatcgcttataccgaacggtttatcagaaagtacgtccatcaatccatcgacattatcgtcacgcctacattgtctttacttatcaccgggctggtgacatatgtcgtttttatccctgcaggcggttttatttctgatctgattacatcaggtttattgtcgctgctgaatgtcgggggagtgctctcagggtttgtactgggagccgccttcctgcctcttgtcgtcaccggcctgcatcagggcttgactcccgtacatttggaattaatccgatcaatcggagatgacccgcttcttccgattctcgcgatgggaggcgcgggtcaagtaggcgcggccttcgccatctttatgaaaacaaaaaaagcctcattaaaaagagcgatcggcggcggacttccatccggtctgctcggaatcggagagccgcttatcttcggcgtcacgctcccgctcggccggccgtttttgacggcgtgtttaggggcgggaatcggcggcgcctttcaagcccattttcaagtggcgactttttcaatcggtgtctccggccttccgctctcgtttctcgtacagccggctcaaatcgttttgtatatcatcggtctcttcatctcttacgcggcaggctttgtcttcacttatgcgttcggatttaaggatgacatggctgctgaatttgaataaaccgggagggatcagaatatgaaaacactgacagccgccatactcacaatggtcatcagcctctcttttctgccgcagcacaaagccgaagcccaatccaaattatacgacgcagcaaagctcagaaaggttgatcaaatgattgaaaaagacatcgcagcaggattccccggagccgtcctcatcgtcgtaaaggacggacgggtgatcaaaaagaaagcatacggctacagcaaaaaatatgacgggaacacccttttatcccgtccgaaaaaaatgaaaacatcaaccatgtttgatttagcttccaatacaaaaatgtacgcggccaattttgcactacagcgactcgtcagccagggaaagcttgatgtgtatcaaaaagtctcggcttaccttcctgatttcaaagacagaaaaagcgatccgattcaagaaaaagaccgtatacgcgtcatcgatgtgctccagcatcaatccggtctgccggcaagcttttatttctatcagccggacaccgcaggccctttatattcacaagaacgggataaaacaatccgttttctcacccagatcccgcttgaatacaagccgggaacaaaacacgtatacagcgatatcggttacatgattctcggatgcatcattgaaaacataaccggaaaaacccttgatacctatgcggaacaagaactgtacaaaccgctgaaactgacgcacacactgttcaatccgctgcaaaaaggttttaaagaaaaagcattcgcagctactgaacgtttaggcaacacacgtgacggagtcatccatttccctcacatcaggacatatacgctgcagggggaagttcacgatgaaaaagcattttactcaatgggaggggtgtccggtcacgccgggctgttttccagagctgatgatatggccgtccttcttcaagtcatgctgaacagaggcagttataaacacgtttctctcttcaataaaagaacggccgatttgttcacaacggcggcatcctctgatccgactttcgctctcggctggcggaaaaacggcagcccggatatggagtggatgttcggaccttatgcaagcaggcaggcatacggccatacgggatggaccggcaccatcacgattattgatcccgcttataagctggggatcgcacttttgaccaataaaaagcattcccccgtcgtcagccccggtgaaaacccgaatgtttttgaaggggatcttttcccgaccggaagctacggcagcgtcataaaagcgatttatgaagccattgaatgacaacccatgtcttttgtccaaactatgacggcaggagggcaccatcatgaaacttttcatctcagctgtattactgttgttcattgtattcggcacgcatcatgcatcaacaaaaccggacattccgtcacaggcggaacaagcggtatcccgtatgacgttagatgaaaaattagggcagatgctcatgcctgattttcgaaattggcaaaaaaaggggcagtcatcacctgaggctcttacccaaatgaatgacgaagtcgcagggcttattcaaaagtaccggttcggcggcgttatcttatttgcagaaaatgtaaaaaacactgagcaaacggtacgcctgacagatgcctttcaaaaggcgagccctgacattccgctattattaagcattgatcaggagggcggcatcgtaactagacttggtgagggcactcatttcccaggcaatatggcgctcggggctgctagaaaaacagcctacgcgtcccagaccggcgccattatcgggaaagaactgaaagcactgggcattaatacgaatttcgcgcccgttctcgatatcaataataatcccggaaaccctgtcatcggcgtcaggtcgttcagttcagaccgtgatctgacagcttccctcggccttgcctcaatgaaggctcagcaaaagcagaatgtcgctgccgccgtcaaacatttcccgggacacggcgacacggatgtcgacagccactacggtcttccgcttgtcacccacaatcaagaaaggctgcgtcagattgaactttatccgtttcggcaggccattcaggccggagctgatatgatcatgacagctcatgtgcaatttcccgcttttgacgatacaacctataaaagcaagctggacggttcagacatcctcgtacccgccacactctcgaaaaaagtgatgactcatcttctccgtgaggaaatgggatttaacggcgtcatcgttacggatgcattaaatatgaaagccattgccgatcatttcggtcaggaagaggcggtcgtcatggcagtaaaagcaggagtcgatattgccctgatgccggcccaagtgacatcgctgcaaacggaaaaccgctttgcccgggttcattccgcgttaaaaaaggcggtacaaaaaggggatattccgctgcagcaaattaacaaatcagcggaacgcatcatttccctgaaaataaaacgagggatatatcccgcaccgaaagagacaaatctgaaaaagaagattgcaaaagcaaagaaaaccgtcggcagcaaaaatcacctgaaagctgaaaaacaaatcgcggaaagatccgtcaccgtcttacaaaacaaaaaccgcacgctcccattcaaaccgaaaaagaacagccgcgttctcattgccgctccttatgaagatcaaacagcggcaatggaacaaaccattcggcagctcatcaagaagaaaaaaatccggccggtaaccatcagtaaaatgaacttcgccgagcgcacatttcatgatgaacacaaaaagctggtatccgacgcggattacgtgattacaggctcctatgtcgtaaaaaatgaccctgtcgtaaacgacggcgtgattgacgattccgtcacagatcccggcaagtggacgaccgcatttccgcgggccgtcatgaaagccgcacaatcgaaccaaaaaccctttgtgctgatgagcctgcgtaatccttacgacgccgcgaattttgaagaagctgaagcccttatcgcagtctacggctttaaaggatatacagacggacaattcctccagccaaacattccggcaggcattgaagcgatattcggacagacaacaccgcaaggcaggctgcccgctgacattccttcagtcacgcatccgggaacgacactgtatccttatggtttcggtatcaatctgaagaccggaaaaccgctttaaacaggagggctgattatgaaaacacatacggctgcacttctcgccggacttgtcgtcatcagtgctatgacggcagtctcggcggcttctgacagaaaccttcataccgccaagaaaccaagcatccaaacaggcatcgaccgcctgctgaaagattataaacaggaactgaagggaaaaagggtcgggctgatcaccaacccgaccggtgtgaacgcatcattgaaaagcagcgttgacgtgctgtatgaggcgccagacatccgcctgacggcattattcggaccggagcacggtgtccgcggcgatgctcaggccggagacaaagtcacatcctatatagacgaaaaaacagggcttcccgtctacagcctatacggggagacgaggaaaccgacgcctgacatgctgaaagatacagatgtgctgattttcgatattcaggatgtcggaacccggtactacacctacatttatacaatggcctatgccatggaagcggccaaagaaaaaggcattcctttttatgtcttggaccggccgaatccgcaaggcggacgaaatccggacggcccggttcttgaaccggattacgcttcatttgtcggactgtatccgatcccgctgaagcacggcatgacgatcggtgagcttgctcttttattcaataaagagtttcatattggcgctgacctcaccgtcgtaaaaatgaagcgctggaagcggacgatgacgattgaagataccggtctgccgttcgtcctcccttcgcctaatatcccgaccccggacagcatatttgcatattcggcaacaggactaatcgaaggcacaaacgtatccgaaggaaggggcacgacaaagccgtttgaacttatcggcgcgccttatatgaaaagcaccgagctcgaagaacgcctgaacagtctcaagctttcgggcgtcaccttcagagccgcttcattcatccccagcttctccaaacaccagggcaagctgtgccacggcgtacaagtctacgtaacaaacagaaacacatttgaagcggcaaaaacagggctctccattctgaaaaccatgcatgacttatatccgaatgacttttcattcttgccgacaggctcttttgacaagctgatcggtaacggctgggtacgcaaaaaaatagaaaaaggcgcttccattgaagacatcaccggcacatatcaacgccggctggaccaattcaaaactctaagaaaacaatacctcatatactgacaacattcgtgttacacgtgtaacattttgacgcatttcacatttccgctttttataggaaaacattcatttatttggtacaatttaaatgataactgttatcatttaaatgaatgtttcctaaaaggtggtttctcatgaaaaacacattattctttcagcccattgatatcatctccgtgaaaaaaacagccgaccttctgtcagagcatcagctcactgattcccccgtattgatctttcatgtgaaaggcgagggacaaattgatatcggaacagacagctttccgctgcagaaggaaacgctctacatctgtccttgtgatgagacattcaatattgcccctatatcgtcaggcggcatccatttgtatatcgtcagactccgtgttttctcctattcctcagatgatgaagcgatgcttccggataacggggaagacatcttccacggacttcagcaaatgaatttacaaacggttgatcatttgacaagccggcttcaatcactttctgaaaacgtgcgatcggcggatggattgcagaaaatgaaatataccgccgactttcagcagctgatgtacgacctttatgccgcaaaagtatgccatcaaaataatacgaaagcggcgatcgaacagacaaaacaattcatacatgctcagtccgacacaaaaatcacgctcacccagctcgctcatatggcgggaatcagtcccaagcattacagtgaaacctttaaaaaactatacgggcagagcgtaactgaatatatcacagacatccgcataaccaatgcgaaaaaactgatggccaaggcaagctgcaaactgcgggaaatcgctcatcaaatcggctaccaggacgaattttatttcagccgcatctttaaaaaacataccggcagctcacctacaagctacatgaaaaaaaggcgcacaaaaatggccgcgtacggaaaagaaacgatggggcatctgattcctctgcatcacgtgccttacgctgcggcgctgcacccgaaatggacggcctattattacaaacaattctcttccgatattccggtccacctgagcgcttaccgctataatgcaaattgggaagagaacctgcatacgctgtctcaagctgccccggacattattttcagtctcgattctgtcagtgaagaagaaaaacagcgcctgaatgacatcactgaagttttttatcttccggctcaagagaattggagagaccagtttcttcgcacagccgcatatctgaatgaagagcaggaagcgcggcactggcttaaaacttatcaaagtctcacccattcagcgaaagatgctcttaaacatgtgcggcaccagcggttcttatttgtccgtgtatataaagaaaatatgtacatcgcccataacaacagtattgaggaagtcttcttcggtgatttggactttgcctccgcaaaaccggaatcatttgctcctgacgaaaagatttccttggaaatgctggcggattgccaggctgactgcatcatgcttttcacttgtaaagaaccggaaacgcttcgctattttcagcggattcagcagtccgggatatggcagaaccttagtgccgtcagcaataaacgcgtgtttcccatttcatctgacccgtggattgaatattctccaagcggacatcagcggatgatcgagcaaagcatttccattttatccgaagatcgtccatggtaatgccggaaattatccatggtcttatccctattcattctctataattccaattgataatagttatcaattgaacaggaggaacaatagatgaagaaattggcattcgctttcatgattttgcttttggctttcacggccgcggcttgcggaagctcagaaacaactgatacagcaagtaaaggaaaggacgcttcttcagataaaaagaaaatcgaatatctcggaaaaacatatgaagtcaaagcgccgactgacaaaatcgccattacaggcagcgtagaatcaatggaagacgccaaattgcttgacgttcatccggcaggagcaatttctttctccggcaaattcccggaactgtttaaagatattacagataaatccgtatcaacgggggaaaaaatgcagccgaatatggaaaaaattcttgagctgcagccggacgtcattctggcatcaaccaaattcccggaaaaaacgttgaaaaaattgagcggcaccgctgaaacgatccctgtctctcatatctcatcaaactggaaagaaaacatgatgctgctcgcccagcttacagataaagagaaaaaagcgaaaaaaatcatcgcagattacgaacaggacctgaaaaagacaaaaacaaagatcaacagcaaagcgaaacagtcaaacgcgctggtcatcagaatcagacaaggcaatatttatatttatcctgaacaagtttatttcaactccacgctttacggtgatttaggcctgaaggcgccggacgaagtcaaagcggcgaaagcgcaggaactgatttctcttgaaaaattaagcgaaatgaaccctgaccatatcttcgtacaattttctgatgacgaaaacgcagataagcctgacgctttgaaagacttagagaaaaatccgatctggaagagcctgaaggcagtcaaaaaagaccatgtatacgtcaatacgattgatccattagcccaaggcggaaccgcgtggagtaaaatcagcttcttacaggttgcggctgacaaattgactcaagactaataaagagtaggtttttcacatgtatgcaaaacggcggacacacattattatcattgcttcaccgattgctattgttctgtcactgctcctttccgttttatacggcgcaaagcagcttgacatccataccgtgttctccgcattgctgcactttaatccggagaataccgaccatcagatcatatggcattcaagaatcccgagggctgccggtgctatgtttatcggcgccgcccttgctgtttccggagcgctcatgcagggaatcacacggaactatctggcctcgccttcgatcatgggtgtgtcggacggctccgcttttatcatcaccctttgcatggtattgctccctcaatcgacatccattgaaatgatcatctactcgtttatcggttccgcattcggcgccgctcttgttttcgggctggcctccattcttcccggcggttttaccccggtgcagcttgccattatcggaacggtgaccagtatgcttctcagcagtctgtcggctgcgctttcgatttattttcaaatttcgcaggatctcagtttttggtacagtgcgagactgcatcaaatgaaccctgattttttgaaactggccgtcccgttttttgcgatcggaatcattacggccatgattctcagcaaaaaggtcactgccgtatcattaggagacgacatttcaaaaagtctgggacagcagaaaagaaccatcaaactcatggcgatggcggctgttgtcatattgaccggaagctcggtggcgctcgccggaaaaattgcctttgtcggtttagtcgttccgcacatcacacgttttctcgtcggatcggactacagcaggctgatcccatgcgcgtgcattatcggcggcgtctttctgaccctttgcgaccttgcgagccgattcatcaattatccgtttgaaacgcctattgaagttgtcacttctatcatcggtgttcctttctttctttatttgattaaaagaaaaggaggggatcagcgtggtgcgtaaaatggcaggaatttatatcattctgattgctctcatattgctcgtaagctatttcagcatgacaagcggttctttttccgcaaagccgggtgaactgctcagtacgcttttccgcatccatccgaatccgcaatatgacattttgctgtttcagctgaggctgccgcgcatagtcatggctgctgccatcggactcggattggggatagccggagctgttattcaggccattaccaaaaacggtcttgccgatcccggtattttgggcattaatgcaggagccggagcgggaatcgtcacgtttatgcttctgtttcagggacaatctgaagcgacggcacttgcctctgcgatgggtatgcctgtcttcggcctcatcggaggactgatggcggccgtgctgatctatattttcgcctggcaccgggggcatctggaatcgggcagaattattctcgtcgggatcgccatgaattccggattcagcgcgctgtctttatttctatcattaaaaatggacccgcaggattatgagatggcgatggtttggaaaaacggcagcatctggtcggcaaactggatgaccattacggcaatccttccgtggctgatcttgttcattcctcttcttatggcgaaaacgtcattgcttgataccattcgtttcgatgaggacacggtgaaaagcctcggtgtttcaaccaataaagaaaaaaccattttgctcattgcctgcatcgctttgatcagcgcatgtgtaaccgcagcgggcagcatggcatttgtcggactgatcgcgccccatatttcccgcaggctcgccgggattgagcacagatactcattaccggtcagcggactggtcggtatgctcctcgtcatatccgccgactttgcgggcaaattgttctttcagccttcagaagtgccggcgggaattatccttgcaattctcggcgttccttatttcttttttcttctgtttaagcaaaaaaaggggatggacgcatgagaggcacccttacagaacacccgataaacggaagggaatgcactgtgtatcttcctccttcctattcggttcaaacaggggctttaccctgtgtgtacgtacttgacgggggttctttgtttttagaacagatagataagcttgaatcccaatttacgaacggaacacttcccgaattgattttcatcggcatcaaaccggctgacagactcgatgagtacacaccgtggcccgcgccttccctgagccctgcgtttcatgatttcggcggcaaagggaggctctttctcgaggagctgacaaatgtcattattcccactgttgaagatacgcatcacatttctgcgcatccggaaacgagaggactgatcggtgcgtcattaggcggactgttttcgatatacgcgatgctgcaaaagcctgaaatattcggcagaatcggctgtatttccggttccttctggtatgaaaaatcagcagattatgtccgctccgcacctttgcggccggcacggcagcgtatctttatgtctgtcggcagccgtgaagcagagcaaaaatgtaacatccaaaacaccatgatcggacaaaataaagacgtgtacaaaagcctgaggcaaaaaggcttttctcaatctcagctctcattcacgatcgaagagggcgccgtgcaccatcaagaagcgttcaaacgacaatttaattcagcactaagctggctgtacggaaaaaaccgctcacgtgactgagcggtttttttcatacttgatcacgaccggcttaagctcaaagcgtctcagcaaatagccgaacaaagcggcaaggatttgctgaaagagcatcccgatgacgaccggaaccgccacttgagacggaaagaaagacacggcgagaacggctccggcgctgatattgcgcatgccccccgtataaatcagagacacgatttcatcctggctccgcttcatcagtcttccgatcagccaagccacggcataacccgtcatggcaataaaaaataccgtgcctgcgatgcccgcaaatttgatatccacgtgcgtgacatacggcgcgatttccgaactgttaatggcaatgacaatcatcagacagatttttgaaaaaggagacagtgaccggcttatcgcctgagtccttaccggcggggaaaactggttgaccatcatccctgcgatggacggaatcaccaccatctccgccagccctttcatcatgccccacacatccatctgaacattcgccccggccaggacagacaggcttaatggtacgataaaaggagaaagtacggtatcaaccaggataatagacagcgtcaatccgacatttcccttatacatcgcagcccaaatcaaactcgtaattccggtcggaatcaccacacccataatcagccccgtcacagttaaagggtcaccgctgaaaatcagatggccgcttccccatgcaaaaacaggcatgaaaatatgcagaacaaacaatgccatgatcatcgggagcggcttctcgatactgcgcttcagcgattgaaaattggcactcagactgcccgtaaatgtaataaatgcaaatatccacggcacagcgccggccatccagctgatatgctgagataacagcacacccgccgccacactagacggagtcaaaagcggcatgattctccccaacacttggttcaacttctgaagccacatcatatgcaagtctcctatatacggttttcaagtctcattcattataacaatgcacaccggcaaatttaaccgaaaaaaagcccggatatattcatccggacttcacaaattctatgccatttgtttcattaaatctcggcttttctgatttaatccctttaattcagcctcaattccgtattctttacatttggcgacaatcttctcaagagcagccgctccagaatcatcccacacgtgggcatcagtcaaatcgatgataatccgtttcacgtcttcatcataaacgatggcattcatcagttcagacacggaagcaaaaaagatctgtcccgttaccttataagttctgacatctttctgttcggaatgtgacacaatcttcagcttagaaattttcgccgtaaaaaagatcgcgcttagcagcacacccgcgaaaacacccttcgataaatcatttgtcagaacgaccgtcacgacggtaatcaccataacgatcgaatcagtaaggggcgctttccgcaaacctttaatcgatgaccagtcgaacgtgccgatggacaccataaccatcacggccacaagcgcagccatcggaattttcacgacgataccgcttaatacggcaattaaaaacattaaaaacgctccggccgtaaaagccgacaaccggccgcgaccgccggctttcgtattaatgacagactggccgatcatggcgcatccggccatgcctccgaaaaacccgttcacaatattggcgatgccttgtccgcggctttctttgttcttatcactatccgtatccgtcatttcgtcaatgatctgggccgtcagcaatgactcaagcaatccgacgaatgcaagcgccagtgaatacgggaaaataatccgcaatgtctcaaacgtccacggaacatccggtatcaagaaatgcggaagtgaacttgtaatcccgcccatatcaccgaccgtgcggacatccgcatggaagaccaccgcaatgatcgtcatgacaataatcgccaccagcggagacggcacagccgtcgtaaccttcggcaaaagatatatgatagccagtgatccgacaagcatggcgtacatgacccatgaagctcctttgaactgcggcagctgcgcagaaaaaatcaagatcgccaaagcattcacaaatccgatcatgaccgaacgcggaataaatttcatcaatttcgctatcttactgacaccaagaataaattgaataatacctgtcaaaatggttgccgcaaacaaatactgcagcccgtaatcagccaccaatgtcaccatgacaaccgccattgaacccgtagcggctgaaatcattcccggtctgccgccgaagatagaaataataatcgcgatacaaaatgatgcataaagcccgaccatcggatcaacacctgcaataattgaaaatccgatcgcctcagggatcagagcgagagcaaccagaataccggccagaatgtctttacggacattcccgaaccattgctgctgtaacgtataatctttcaaatgataacgactccttttcactataaaaatccgcaccttatcagttggaaacattgatttttatctggggaatatgaggcaagcttacggggaaaaggggacacgctcagagtataatgtcttgaggaaaggaatggttaacaaagagtatcatattaaactttaaagaaatgtgcaagaccgtataaaaaagaaaagaaaacggctctcactggagccgtttccgcttttataaaagttccggatcagacacaagaatcgtttttattgcgctgatatcctttctttcttttgtcaccgggtcgatgcccatgagatgatcaatggcttcttcataattcttcagttccgtcttttccgtaataaaatcatagagctgcggaaggtcggatgcacatgctaacgcagcctccatgatctgacgggcttcacctgtgcccacaatcgttacgccgtttgacagcagctgatacggcctgactgtcatctcatacgtatcatcaaagcccatcggcacgattctgcctcccttttcaataaaaggataagcccaatcaagctgattgccgatcgcgtcaaaaattacatcaaattttcttccttgattaatccgtttcacttcatccacggttaatgcttcagggtggtagacataatccgatatccggctcgccgcctcgcttcggaaactgcctatttcagtcgcaaccgtcaatcgcgccagttttttcaccatcatttgcacaagcagtccgattggccccgaccccaaaaccaagaccgagtcctccggctgaatcgaagctttgtccacaacattcagcacacaggagagaggctcaaccaatgtggcccgctcccattccattgaatcgggaattctgtacatgaacctgtcttctccgacgtaatattccgcaaacgttccgtgcgccccgattccgagctgccaatcctcgaaggtttcgcaataacacgtcagccctctccggcaataatgacatttcccgcaaaactgcgtaggatctatcacgacgcggtctccgacttttacatttgtcacgtccggtccgatttccacgaccgctcccaccgattcatgccccataatcatatgatgggttgcattcatttttcctttcagcacatttaaatccgttccgcagataccggtgccgaaaattttcactttcacatcattggatttccgaatttgaggctcgtccacctcttgatattcaagcttatcattaggagtccagaccaacgccttcatatttctcttcctttctgccccagcggatttggtctaacaatgtttgatgaagctccttcgttgatgccgcaatacatgattgctggttctgataacttaaatctgtcagaagcgtttcgtccaaagaccggccgtatgcatccgtaatgaccactcctgctttcttcgccaaaaagacgcttgcggcaatatcataaggaaacaaatgcagcacctctccgtttccgacctgctgaaaatctgaaagcagcttcggatcatctttcagcagacgattgccgatatccacataagcatccatctgccccgtgataattcgtgaaatcgaataagaagcgctgttgaaaacaaaaaccccgccattattggctgaccggtcaatcagatgaccgtatgcatccgtcatcagctgtgccggatgcccgttaaactcaaggctccaaaacatatttttaatatcccgcacttcgctcaaattcggcaattctccctgatacccctcaaactgaatggcgtcgctgtaaatatcaccgtacatgtaagcgcccgatttcaattcaagcaaaaaagcaaattcgatatccttaatctttgcgtttggcttatacgaagcaagcgcaatcgaaatacacgacatttcaagccccgcggcggccggacgcgttccgtctatcggatctacaattaaaatatattgcggatcttctccaatcagcttcaggccgccatcctccgtgtaaaaagcaaccggatggcccttatcttgaatataatccagcaccgcctcctcagcagcggcgtctatgttaaattgggcgtcgcctcccggagaatagccgtttacgagccggtttttcagcgtgcctttttgacttttcaccttatgataaacaaattgtccaagcccgatgatatagtctctcacttgatttcctccaatagcttgcgaagtctgtagcagagcacttctgcttcactaagtgtaatagttaaaggcggtcggattttaaaaacatttccgaacccgtaacgggatgtccggagaatcagcccgtaatccattgcccgttttgcaatataattggtcagctccacatccggttcattgttctcttttacaatctccacaccgatcataagaccgacgcctcttacctcagaaataaaagcgaaatcctctttcatcgtttctaagcgatccataatataatgaccgaccgtcgttacattttccaaaaatcccggacgctgcatgatatctatggttttacacgcggcagcggcggccatcacatttgagccgtacgtgaaggagtgcgtataccccggaagcccggtatacttgtcctccgtcagagtggcggcgacttggaagcctgtgcccccgagcccttttgctaccgtcatcatattaggtttcacatcgaagtggtccgcggcaaacattttgcccgtccgtccgaacccggtctgaatttcatcaaaaatcagggcgatatcgtgttcatcacaaagctgtctcagctgtttaaaatactctttaggcggaacgacgtttccaccgtttccggatatcggttcaataatcatggcggcaatttttccattgctcgcatactcaataaaatcattaattctttctacgcacagcataccgcatgaatcaggtttctgattataaaaacagcggctgcaatacggatcggggacttgaaggccaaaagaaatttgcggcgggaaaggttcttttctgaatgagttgccggacaaagcggaagtcatatacgtttgtccgaggtggcttcgaaataaggagatgacatcggtttttccggagtaatactgagccattttaatagctccttcatttgcaccggaaccgctgctgactttagggtgtacttttgtgagattatcgggggcgatttctactagtttttctgccagtttatttacggcgtctgtttgaaaagatgatgtcacatggatcagcttatcggcttgttctttaaccgtatcaatgacttctttgttaccgtatcctaaattcaagttaaatgtggcagaagcgcaatcaatgtactcattcccctcttgatcgtacaggtaaatcccttctccgcgctccattactacatcgtcaacactgtaatacaagctgtctggattcgtgatttccttcgttcccacaaataccacccctatgaaattattagaatttcgctttttatcgtattaattattgaaaatattgtcaacgatctttcttgtaaaaaatgttaacaatttgttaacgttaccataagggatgtacgagaaaaagttatgtgatatagtaacaatacttggattttttgtaaaaacgtcatgtcatacgagtagagagaaatattattttacgaataaggagataaaatgatgaaatctcgtctgctgtggataagctgtttttcttatggatcgattgcttttacacttgttattctgggagccgtactgcctgagttactcacacattattcacaaagctacagtaatggcggtgtattggtattctctcagttcatgggctttctcatcggtgttattggcatgccatacatggtgaaaaagcttgggcgcaaaaacgtcgttatctttggcctggcactcatcagctgcgaaatgttcatcaccttcctgccgccctggccgctgctctttcttctcgtcagcatcgcggggcttggcgccggattggtggaatcctgtgtaggcacgatcatcctcaccgctattaaagaaagacaggctgtggccatgagcaagatggaagtggcctacggattaggcgcgcttttcatgcctctgctctcaggctttcttatcaacaaccacatgtggacaattgcttttttagtattagggttatccagttttgcacttttaatcgcatggaagcagatgagtttcggcagtattgatcagcttctcatccgaaaagaggtctcttccgatgacactaaaaaagaaagcaccggttatcggtcacacggattgctgtttattgccttggcgggggcttacttcttcttttacggaggcagtgaagtttcaattgtacattttatcccctccattttctctgagaaatgggatatccccaactctttggcaacgataacagttacagtgtattggacggggatgatcatcggaaggttactaacaggcccggtatcagaaaagctgacatatcaccgttatcttcgtctcataagcattggcggtctggcagcacttaccgtattagcactaagtaaaaacgtatggttcggctttgccctttgcttctttttagggctgttcatggcaggcatgtttgcaatagccctaatcatcacgaatcatttttatcccggaaagacagaaacgactaccagtattctgctcgcttcaaacggattaggaggttcactccttccgatcgccgtcggctggagcttagatgaatatcccgcacaaactgcgttctggctgtttactgcactgatggtccttatgctgctgattgtgttcagtttaagaatactcgagacaataaaatcaaacaatcttcaaaatcacaacagcaaagcaaaatcaatgtaaacaaaaaagctaatgcctttgaaaggcattagctttatatatctatgtgatctttcaaataaaaaaaccagttcatcatgaactggtttaagacagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacatctcgaagaatcgaatgatccttcaaaactaaacaagacagggaacgttctgtttataagacccgaggtcttatattccgttaaaatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattaccgcttgttgaagcagctttattatcttaccactcagcttcttttatgtcaacaactttttttaagttgtttccgaagctttttgttgttgtctgctgtccatcagcgacgtttaataatataccacggtgcttctctataaatcaagcattttttttaaaaagagaaaaaaagaaaaccagtatattatctttaaagcttgagaatggtcgggaagacaggattcgaacctgcgaccccatggtcccaaaccatgtgctctaccaagctgagctacttcccgattttaaaaaatattatggcgcgcccgagaggagtcgaacccctaaccttttgatccgtagtcaaacgctctatccaattgagctacgggcgcaatcaatttcacaatatcccgttgggataaaatggagcggaagacgggattcgaacccgcgacccccaccttggcaaggtgatgttctaccactgaactacttccgcaagtaaaagtgtaatacatggccagaatacagcttcagatagcggtaaaccgtattgttatttatactgttcattatgacaaaagtaattatatcaaggttttgataaaagtcaatatcgtttaacaattaattatgttaatctcttttgcatccttgaagaaaggcttcatcaggagacgcgctaaatacctacaccttaactggtacaatcagcaacaggtttttactgaactaaacaaaaaataacagttccataacattcggaaactgcttcagatcaacgtattttagataagcttccaagcgggctcgaaccgctgacctcttccttaccatggaagtgctctacctgctgagctatggaagcaatggctccgcaggtaggactcgaacctacgaccgatcggttaacagccgatagctctaccactgagctactgcggaatattataagcttcataaacaaaaacatggtagataaaataaaaagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacatctcgaagaatcgaatgatccttcaaaactaaacaagacagggaacgttctgtttataagacccgaggtcttatattccgttaaaatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattaccgcttgttgaagcagctttattatcttaccactcagcttcttttatgtcaacaactttttttaagttgtttccgaagctttttgttgttgtctgctgtccatcagcgacgtttaataatataccatgcatcggctgaatttagcaagtatttttttcgtttttttttgaaacgtatttcgttatattcatctccgccgcggcatacgatgtaatcaagcatggacaagataaggaggcgtcaccagtgaaccacttctacgtgtggcacatcagaaggataaaacagctgcttattattatcattgccgcatttgcagcagccagctttttttatatacagagagccgtcccccttcctgtatttttaactgatagcggcccgaaggctatttcaaaaggggagacgaaagcgggcgaagtcgcattaacattcgatatcagctggggcgatgaaaaagcggttccgattctgaacgcgctaaaagcaaacggtattaaaaacgccactttttttctgtcagcttcttgggcggaacggcacccggacacagttgaacgtatggtaaaagacggacatcaaatcggcagcatgggatatgcgtataagaattataccaacctagaggacaacgaaataaaaaaagatatccttcgggcccagaccgcatttaaaaagctgggtgtgaagaatgttcatttactccgcccgccgaccggacaatttaataaaaaggttcttgccattgcacagcagtaccgctattcagtggttcattacagcgttaactcgcaggattggacaaatcccggtcctgataaaatcattgaaaatgtaaacagtcatataaaaggcggcgacattgtcctgctgcacgcctctgattcagcaacacagaccgaagaagcgctccccgccatcattcacaatttaaagcaaaaaggactgaaaaacgtgacagtcggcgacctgatcgcaaatactgacgtcaagtcatcagaagtgaaataactacctctgggcaaacttcggcagcattaacagctgaaacgcattgcagcccatcagcggaatcagcatcaaataaagccagtcctcattattcactcttagcgcaggaacccattcaagcgctgtaataacgaccattaaaaataatgatgaaacgaacgtattttttgaggactgcttttgttttatatacgccgtcagcaagccgacggcaagcagagccagcggcagccagacaaaccccgcaatcgagtcatcccgctcaccgaaaaacaaaaatctgacgtacattaaatcaaaagcgacaaacagaatgataaacagctgaagcagattccaaagcgagtttgatctgaggatttcaagggcaaaccggtgcaccgtcagaaagacgaagaatcccatctggctgatcacactgaaaatcatgcctaccccgataaaccagatcagaacggagaaaatttgaccggcctcaaaattcagaaagaaccccttgtactccccccacttcagtgcaaatcccacgacgcttgtaataagagcgcccacagctaaaatcgaaaagaaaaatcgaacaagcccgcggcttttcatctcttattcatccccctgacaatcgcgttcagcgatattttgttatgtataaatccattccgatgaatcatattaaaaataagtacaagtaaggaaggagcttatgcatgtcaaaagccaaaacgctattgataagctgttttgttgtattatctgtaacagcttgtgctccaaaagaccaagcagcggatatggattatgaccagactaaaaaaatggttgttgatatattaaagacagatgatggaaaaaaagcaattaaggaaatattaaatgatgatgcgatgaatgaggcattggtgattgatcaaaatgccattaaaggcacaatagagaaaaccctcacctctaaaaaaggggcggagttctggaaaaccatctttgaagactcaaagttcgccgagagctttgcaaaaacgcttcagcccgagcacgaaaaaatcataaaaaaattgatgaaagaccctgattatcagaaaagttttatgcagatcatgcaggaccccggcatggataaaaaatactatgagctggtgaaaagccaaaagttccgcagttacttagaagatgtaattacagagacactttccagcccgcttttcaaaaagcaattcgaggatgaattgaaaaaagcggcttcaagttctgaaaaagaaagccaataaaaggccgggccgtgttgatcccggccccttttttattcagctgttttttcaatgactttttgggcgatacccatataaatttccccgatcggatgacttctgtcatagacagaaggcgcaaactggtccttgtcccaatcaggctgttttaaaggaattctgccaagcagcggcacctgcaattcctctgcaagcttatctcccccgccttgaccgaacacatattctctctcgccggtttttgcactttcataataagccatattttcaatgacccctacaacttcatgatcggtcttaatcgccatagatcccgctctcgccgctacaaatgcggctgtagggtgcggcgttgatacgataatctctttgcagctcggaagcatcgtgtgtacatcgagcgccacatcacccgtgccgggcggcaggtcgagaacgatatagtcaacctctccccagtcaacctcatggaagaagttattcagcatcttgcccagcatcggccctctccacacaaccggagcgttttcttcgacgaaaaagcccatcgacataacctttactccaaatctttcgacaggaagcagtttttctccttcaactgtcgggcgaactgtaatacccatcatgtccggcacgctgaatccgtatatatccgcgtcgatcaagccgactttttttccgagccgcgcaagagaaatggccaggttgacggaaaccgttgatttgccgacaccgccttttccgcttgccaccgcaagaaagaccggcggatgtttcctattcagcagggtttcgctttcagcagcaggccggctgaatttcgccaatgtttcttccggcagctcttcaaaccgaagtcccacagtttccgcacccgcttctttcagaacggatacgatttcctgctgaatgcccatctgttcagccgtccccgtttttgccaatgcaatttttacactgacatgccgtttttccggcttgacctttacttctttaatggcatccaattctcccagcggtctatgaagaaaaggttcgcgcatgtttccgactatatttcttacttcatcttctcttatcatcgaaccctcaccctttgtgtattcgtttacaaatggtattataccatatattaaacgtagaatcggcgaaaaaccctccttactcgggagggtctcctttttctgtaaaatatctcaacacgcccttatacacggaagaagcgattttgtcctgatatttaggctggccaagccttttcgcttccgcgggattggacagaaatccgatttccaccagggcgcccggtttggttacattctgcattaagtaaatgccgtgtatccgtttcgcctttctcgttgtattctccaaattgattctcaattcgtcctgtatatattttgccactttttcattctcttcgtattttccatagtagaagctttgggcgccgctccatctcggtgacggtatggcgttcagatgaatgctgatataaagctccgcctctgaacggttgatgatctccacgcgctttctcagatcttccgctttgcgtctgctgtagcctttcgtcccttcaggagctaaatcagtatccgtctcccgcgtcataatgaccaaagctccctgctcctgcaaatagtctctgaccctggaggccacttcgagagtaatgtccttttcaaggtgactgcctcccgtggcgcctccgtccggcccgccgtgtcccggatcgagatagatgattttcccgctcagcggcaggctccacggccgccatgaatcatcattatggaattgaaaccggaataaacacaataatatgataaagccaagtaaaaaaccgagccatttcagcttttttgtcatagctttccctcccgcttgtccccgttattaataagtatgggacaagggaagaaattatgattacctcatgcggagcttacattgtttttctctttgcagaaatccttccgtccaccagctgttgataaaccggcaggacgcttcatagatttctttttgttcaacggaagaatattgctcatgcgtccaattgcaaagatattcaaaaaaatcggccgtcagttcttcctcttcttcagccgaacgggcgttcgccctctgcaaagactcaccataaaatccaaagacgccgaaccggccgcctaataaatacgcttcaattgcaaaatctatgcatccttcactcagaatgccgttttcgtcttgaagaaagggaaacaaaggggtgagacatgcttttacggactgaatgatctgcgtcagtgacagctcctttagtaaactcttctcaagctcataatccttctgccgtttcacgtctgaaaaagataatacttctgccattgccagccacgctcctttttactgttattttgaaaggaaaagggaaaaagcatgctttgttgatagtggaaatcctcccaaatgaaggagtttcatgttaactggaagaataaagagctgaggtgacgtgatgaaaaagctgtttcaatacaattggacggtgcgtgacgagtggtttatgatatgtgaaaagctgagccgggaggaactgacgaaaacccggacgggcggaatggagagcatcttgcggactttatttcatatcattgatgtcgagatcagctgggctcgtgccattttaggtaaagatgatgttttacccgctgagtctgactatacgagcattcaggatctcagaaagctgtctgaacagtatcgggaggatgtcattcatgcggtctcccgcaaaggggcggatcttgttaagccggactggatggaccaaacctttcctaaagaagatattctccgccacatccttgcgcatgagattcaccacatgggacaactgtcggtttgggccagagagattggaatagaaccggtttcggctaatgtgatcagccgtccgcaggaaaaagccgcaaaaaaacagcacctctgacgggatgccgtttttatattttaatgcttcttgttacggagtatgtattaatgtattcatccagcacgaggccgcctttgtcctcgtaaaaaccggcaaccataaagcctgcgtcaatctgacctttaatttgatcctccagcgtatggccgaattcaagcgcttcatgattatcaataagttcctttacctttttcttactcagatctttttcatccgaaaacggaatggaatactttacttttagtacgccttcctgctctaaatccatatcaaataagaacacgacgggatttacaaaaccggagactaaagacccgccttttttcaatacgcgataagcttctttccataccggaagaaccgtatcaacaaagcaattcgataccgggtgcacgataaaatcaaatgtctcatcatcaaaacagctcagatcattcatgctgcctttgacagtccgaagcgtaagaccgtcccgctgggcaaccattctgtcttgcgcaagctgtttttccgaattgtcaaagatggtgacgtccgctcctgcagcagcaaggaccggcccttgctgtcctcctcctgaagcgagacaaagaacctccagaccgtctatgggcggaaaccaatccgccggcacatcttttccgggggtcattctgatgctccaattgccttttttcgcttcaccaattgtatgagaatcaaccgcaaccgtccattcattgcctgtttcgacttttttatcccatgccttgctgttatgtatgactaacttattcattataactgcgctccttattggtaatgaatagagtataacaaacaattctagaaaaacatcggataacctcttcgatatgagaaaaaaatacaaaaaaaccacaaccaagaagttgtggtttttgccatccaaaacgattaacgttttgagaactgaggtgcacgacgagcgcctttaagaccgtattttttacgttctttcatacgggcgtcacgagtcagaagaccagcacgtttaagtgttgcgcggtattctggatctgcttcaagcaaagcacgagcgataccgtgacggattgctccagcttgaccagataagccgcctccatgtacgtttactaaaacatcataagtaccagctgtttcagttaaagttaatggttgtttgatatcttcgattagagccggagatggaatgtgctcgctgatttcacgattattaacgacgatacgaccttctcctggaactaagcgcacacgcgctacagaacttttacgacggccagtaccgtaatattgaacctgtgccaaattggtaacctcctttttaattaaccgcgaagttcgtaaacttcaggtttttgtgcttcatgtggatgctcagaaccacggtatacgttcaatttcttgaacatttgacgacctagagaaccttttggaagcatgcctttgatagcaagctcaagcattttctcagggtagtttgtacgcatttcaagagctgttcttgatttcagaccgcctgggtgcattgtgtgacggtagtagattttatcagttaactttttaccagttaactcgattttttcagcgttgatgatgatcacatgatctccagtatcaacgtgcggtgtgtaagtcggtttgtgtttcccgcgaaggatagatgcaacttctgtagaaagacgtcctaaagtcttgcctgctgcatcaacaactaaccacttgcgttcaatagtacttgcgttagccataggtgttgtacgcatttaattccctcctaaatgatctgtcattttttcataaacttctgttacgttctatttcacaacacaataagttccggggcttatcgtggggttgaaatacataccatatgatatcttataactttatgcagactctgtcaagaaaatgttacacctggtttagttgtcatagcaaacgctccataaatacagcccgtgccccggtgcggtgcgccccgcggcttcgcgatccttcgcttcgagcattgcttttacatcatcgggagaaaattttccagctcctgtatccaataacgttccggcaatgattctgaccatattatagagaaaaccgtttccggtgatccgcatctgcaggccgtctccggtctcagtccaatccagctcgtaaatcgttctgaccttatcctgaaccgcggtatcagccgcgcaaaagcttgtgaaatcatgtgtcccgatgaggtgccttgaagcttccctcattttctgcacattaagctgatatgcaaaatggtaagcgtaatgtcgtttaaatacgtccgggtgtttctccgtatatacaaagtagcgatattccttttggactgcgctaaatcgtgcatggaacccatcatccgcaatctctgctgttttgacggcaatatcatcaggcagcagggcattgagcgcaaacggccatttctcagccgggatggacagcggcgtatcaaaatgaataacctgcccggcagcatgaacatcgctgtccgtgcggcccgatgagatgacaggcaccctgccgtccgttttatggatgacggccagcgctttttccaattcactttgaacggtccgctttccaggctgaacctgatatccgttaaataaatgcccgtcataagcaatggtacatttcactctcattcagcagcacctctaacttcttaagaaaaacaataacacggctaatacgatgatgagcagaatggctccggtatcctttccggtccagacgagctttctgtatttcgttctcccctcaccgccctggtagcctctcgcctccatggcgaccgcaagctcttccgcgcgtttaaaggcgctgacaaacagcgggacaagcagcggaacaaccgctttgattctgtctttcaccgggccgcttgtaaagtccgcacccctcgccatttgcgccttcatgattttatctgtctcttccatcaatgtcgggataaatcgcaatgatatcgacatcatcaatgcgagttcgtgtacgggcagcttcacctttttaaaaggattcaagagctgctccattccatccgtgatttcaatcggcgttgttgtcagcgtcagcagcgttgtcataaagataaggtaaacgaaacggagggagataaaaatcccctgtataagtccgccctcatacactttaaaccagccaagctgaaaaatgacagatccttcatgcgtcatgaaaatgtgtaataaaaaggtaaacgccacaatccagataatcggcttaagccctttcagcaaaaagctgaacggcactcgtgttaaggcgatcaccccgaatgtaaacaaaccgagcaaagcatacgtttgtacgttgtttgccaaaaaaacgatacatacaaaaagaaagatgctgacaagttttgttcgcgggtccaatcggtgaataagcgatgatccgggaacatactttccgataatcatgctgtccatcattggtccttttcctcctgaaagaaagccttaatttcgctcgcggcatcctgcagggtcagcatgggtttttcatacttaactccgagagcctcctcaagccgtctctgaaacttcaccgactcaggaagatccagtcccatttcggccatctcttcaccttttacaaacaagtcacgcggactccccgtcgctttaatggtgcctttgtgcatgacgatcatttcgtcagcatagcgggcggcgtcctccatgctgtgggtgacgagaacggtagtcaggtttccccgctgatgaagcgcatagaacatgtccataatgtcctggcgccctctcggatcaagaccggctgtcggttcatccaaaaccagcacttccggctccatcgcgagaacgccggcaatcgccactctgcgcatctggccgccgctgagctcaaacggtgaacgatccaaaatgtcttccggaaggcccacaagccccagcatttcttttgctttccgttcagcgtcttctttttttacaccgaaattcatcggtccgaatgcgatgtccttcagcacagtctcttcaaacagctgatgttcgggaaattggaaaacgattccgactttttttcgcagagtcttaaggtctttattctttttaccggctgccagaatcgtgctcccgagctcaagctgtcctttagtcggtttcagcaaaccgtttaaatgctgcaggagcgtcgatttgcccgaccctgtatgtccgatgacggcaacgtagctgccctcttttatcacggcattgatatcatacagagcaagccgttcaaacggtgtcttcatttgatagcggtgttctacatctttgattttaatgtccacagctcattcaccagcccttcctgagtcagatggtttttcgttaacgccagtccgctttctttcaaaagcaggctgagctggaatgagaaaggcaaatcaagaccgatgcgaaccaagtcttcatttaatttaaaaatctcttcaggcgtgccctctgcatatttcctgccgccgttcatcacaatgatcctatccgcccttgcggcttcttccaggtcatgtgttatcgaaatgacggtggccatgccctgatcttttaagcgtctgacagtatcaaggacttcttctctcccaatcgggtcaagcatggatgtcgcttcatccaaaatcataatatcaggacgcgcggcaataattcccgcgatcgccactctttgtttttgacctccggagagatggtgcggctcttgatcaagaaaatcctgcatattgacttgtgtgacagcccaatctactctctcaatcatttcttcgcgcggaacaccattgttttctaaaccaaaagccacatcatcgcgaacagtcgttccgacaaattggttatcgggattctgaaagaccatccctattttttttcgcacatcccacacggtatcctcagtcagcttgatgccgccgacttcaatttctccggcctcaggcaaaatcagcccgttcagcgctctggccaaagtcgacttccctgaaccgttgtgacctacgatagcaagccattctccttcatatacctccagactcacaccgtccagcgccggtcttactgcatctttgcggtagcggaatagaatgtcttttacggatataagctgtttttgatccacgggcgcctgacctcctctcagctatagctctgcttttctgtctcatgataaaaagttctgatatctaaaaaaagggcatagatccagttagaaactgtcccgcccttctttagatacacaaaaatatgtgattaaaccaattcgatgattgccattggtgcaccgtcaccacggcgaggaccaagcttcataatacgtgtgtatccgccttggcgctcctcgtaacgagttgcaatgtcagagaataatttttgaagtgcatcttggttattttcttcattagcaacctcgttgcgaatgtatgcagcagcttgacgacgagcatgcaagtcaccgcgcttaccaagagtgatcatcttttcaacaacagagcgaagttctttcgcacgtgtttcagttgtttcaattctttcgttgatgatcaaatctgttgtaagatcacgaagcatagctttacgctgtgaactcgtacgtcctagttttctgtatgacatgtgatgtcccctcctttaatggaatgctgtttctaattaaaaaacacacgaaaatcctagttcacatggaaactagatcaatcgtctttgcgaaggccgagtccaagttcttcaagtttcgctttcacttcttcaagtgatttgcgtcccaggttgcgaactttcatcatatcttcttccgtcttgttcgcaagttcttgaaccgtgttaatgcccgcacgcttcaagcagttgtaagaacggacagaaagatcaagttcctcaatcgtcatttcaagaactttttctttttgatcctcttctttttcaaccatgatttcagcatgctgagcttcgtcagttaaaccgacgaatatattaaggtgttcagttaaaatctttgaaccgagagcaattgcttccttcggtccagtgcttccgtcagtccaaacatcaagtgtaagtttgtcatagtttgcaacctggcctacacgagtgttttctacctgataagataaacgagaaactggcgtaaagattgaatcgatcggaatcacgccgattggctgatcgtctcttttgttcgaatcagcaggtgtatacccacgtcctctttgtgcagtaaggcgaactcggaaactcgcattctcaccaagagtcgcgatatgaagatccggattaaggatttcaacatcgctgtcgtgtgtaatatcagctgctgtgacagttccttcgccctgtacatcaatttcaagcgtcttctcttcatcagagtagattttcaatgcaagctttttaatgtgcaagattatcgttgtaacatcttccacaacgccttcgattgtcgagaattcgtgcagtacaccatctatctggatcgatgttacagcggcaccagggagtgaggataagaggatacgacgtaaggagttacccagagttgtaccatatccacgctcaagcggctctacgacaaacttaccaaatttggcatcgtcgctgatttcaaccgtttcgatttttggtttttcaatctcgatcattacttaaaaccctccttcaaaacgtcgaaacctcgaatagaatcatatgagattccatccgaaattccccattgtttagtcccgtatgtgctcaggcaacgagtcggtgcattcgtttcataaataactgtatcataacccattattgacagggacacaaaatctatacaaacaaattacacgcggcgacgttttggtggacggcatccattatgaggaacaggagttacgtctctgatagctgtaacttcaagtccggcagcttgtaaagcacggattgcagcttcacggccagaacctggtcctttaacagttacttcaagagttttaagtccgtgttcgattgaacctttagcagctgtttcagcagccatttgcgcagcaaaaggagtcgatttacgagaacctctgaatcctagagctccggcacttgaccaagaaatagcattaccatgagtatcagtgatcgtaacgatcgtgttgttgaaagttgaacgaatatgagcgattcctgactcaatattctttttcacgcgacgtttacgcgtgttttgtttacgagcagcagccattgtttaggtacctcccttacttattttttcttgttagctacagtacgacgcggacctttacgagtacgcgcattgtttttagagttttgtccgcgaacaggcaaacctctgcgatggcggattccgcggtagcttccgatttcgatcagacgcttgatgttaagagaaacttcacggcgaaggtcaccttctactttcagtttgtcaataacatcacggattttaccaagttcttcttcagtaagatcacgcacacgagtatcttcagaaacaccagcctctttcaagacttgctgagccgttgtgcggccaattccgaagacatatgttaaagaaataacaacacgtttgtcacgtgggatatctacaccagcaatacgagccattctctgggcacctccttattaattatccttgtttttgtttatgctttggattttcacagatcaccattacttttccttttctgcgaataactttacatttctcgcagattggtttaactgatggtctcactttcatgtgtttccaacctccttcagtttccggagtgctttatttgtaacggtacgtaatcctgccacgagttaagtcatatggagataattctaccgtaactttgtctccaggtaaaatgcgaatgaagtgcatgcggattttaccagatacgtgagccaaaaccgtatggccattttcgagttcaactttgaacatcgcgtttggcagtgtttcgacaatcgtaccttccacttcaattacatcgtctttcgccattcaagtgttctcccttcttcaaatcagtaacttgctctctgacaaatttcaaaagagaaaatctcagttatccgtttgtcacacgccctgtttcgtttatactgttctgaacttccggagatacgcaatcataaagggtgaatgattgatattctttttctaaggagaatgaaatgtacgcttttctccgtctgctttagtacacgatgatgaatcttccttccgatgacagcagctagccggtttttcttccgaccaattgtaaacctacaatctgcccaggtgcggaatgaaaaacatgtgtcatggaattcatttcatcatctagacttttgtcagtatatcaaaacccgtttccgtaatcgcaatcgtatgttcaaaatgagcacactttttcccatctaccgttacaaccgtccagttatcagccaatgttttcacataccggctgccagcgttaaccatcggttctatagcgagaaccataccaggcttcagcctaggtcctttgtttggcggaccgtaatgaggaatttgcggatcctcatgcaagtcttgaccaacaccatgtccgacatactccctaacaactgaaaactgctcattttcgacatacgtttgtattgcgtgggaaatattcgacaaacgttcacctggttttgcttccttcaagcctttatataaagactcctctgtcacttccagcagtcgtttatcatcatcactgatgtttcctaccggatatgtccaagcagagtcaccatgataaccatttaatttagcaccgatatcaatgctgataatgtcaccgtcacgcaaaacccttttaccgggaattccgtgaacgagttcttcattaactgatacacagatgctcccgcgaaacccattataccccttaaaagatgggattgcaccctgcttctcaataaaacgttcggcaatttgatccaattcttttgtcgagattcctggtttaatgtgctttttcatctcttcatgagtcaaagccacgattcgccctgcttcccgcatgatgctaagctcacgaggggtcttacagataatcatttgctcaatcctccaagaagctctttcacatctttgtacacgtcgttaatgtcctgctggccattgacgttgacaagataccctttctcagaataaaaatcgagtaaaggctgagtctgcttcatgttgacctcaagccgttttgagacggtttcctcattatcatctgcccgttgataaaggtctcctccgtctttatcacaaacacccggcgttttcggcggattgaaaaccaaatgataggttgtgccgcaaacactgcaaattctgcgtccagtcaaacgttccattaaagagtctttgtctactttaatgttaatgacataatcaatcggcttgccgtattcctcaagaatgttttcaagagcttcagcctgagcgactgttcgcggaaatccgtccagaagaaaacctctttcacaatcatctttgccgagtctttctttgacaatgccgattgtgacttcgtccggtacgagctcgcctttatcaatataagactttgcttcgagtccgagtggtgtttcttctttcatagcagcacggaacatatctcccgttgagatatgaggtatcccataatcctcaacaattcgttctccctgtgtgcctttaccggctccaggaagtcccattaagactaagttcattcggatttcccccgtcctctcttatttagaggaatggttaaaaccagtcctctaatttttcataaatcctcggtaattacgtttcactaactggctctccagctgcttcattgtctccaaggctaccccgacgacaattaacaatgatgttccgccaatctgtgcactttgaggcaatccagcgaattgaatgaaaaagataggaagaatggaaatcacggctaagaatatagaacccacaaacgtaagtcgatacaaaatgctcgtaattctatcttgagtcattttccctggacgaacccccgggatatagccaccctgtttttttaggttatcagccatttgttcagggtttacctgcacaaaagcatagaagtacgtaaaggcgataattaatgcgacataaaccgtcatgcccaccggatgtgtattgtcaaagttggcttgaatccactttgtcacatcgttttctccgaaaaatgacgcgatagtacgcggcgtaataaggaacgcaaccgcaaagattaccggaataacccctgccggattcactttaagcggaaggtgagttgactggcctccgccaacaggtgaacgaccttgcccttttgcatattgaatcgcgattttgcgtacagcctgctgaatgaaaataacaccaacaataacggctaaaatcgcaatcaccagtaaagcgattttcacaatatgaataaacagctgatcgctgctgccgacaaattgagtctcataaatctgcccaacagttttcggaatactagccacaatccccgcgaagatgatgatcgaaattccgttacctactccattggaagtaatttgttctcccagccacattaaaaaagcagttcctccagtgagtactaaagcaataatcagatatgtcgatatgccggatttttcaatcagcataccgtttgccaggttgttaaacccgtaagacatacctaatgcctggataaaaccaagcacaatcgtaaaatatctcgtgaactgagctaatttacggcggccgacttcaccttgcttagaccactcggtaaacttcggcacaacatccatctgaagcagctgaatgatgatcgaagcagtgatgtaaggcgtaattcccatcgcaaaaatggagaactgataaagcgcaccgccgccaaatgtgttaaggagatcaaaaacccccatcgaactttgtgtctgcaacgcctgagcatttacatatggcacagggataaacgcacctatgcgaaagacgataagcatgagtaatgtaaaaatgattttattccgaatatcactcacacgcataaagttggagattgtcttaaacaagttagatcacctcagctgtaccgccagcagcttcaacagcttctttcgcagaagcagagaatttattggcttttacagttaattttttctctaatttaccgttgccaagaatctttactcctgcattaagtttgctaataacaccagtctcaagaagaagttcaggagtgacttccgttccttccgcaaaaccgttcaatttgtctacgttcacaatagcgtattccttacggttgatgtttgtaaaaccgcgcttaggaagacgttggaataaaggcatttgtcccccctcgaatccagggcgtacaccgccgccagaacgagcgttttgacctttgtgacctttaccagctgttttaccgttaccagaaccaataccacgacctacgcgattgcgtactttacgtgaaccttctgaaggctttaattcatgaagtttcattaggacacctccttagcctataatttatttttattgttctttaacagaaactagatgagatactttattaatcataccgcggatcgcagcgttatcttcatgaacgacagtttggtttgttttctttaaaccaagtgttcttacagtaacgcgctgatcttccgggcgaccgattacactgcgtttgagggtaatttctaatttagccattaatgttccctccttatcctaacagttcttctacagattttccacgaagcttcgcaacctcttcggcacgtttaagctcacttaaaccttgaagtgttgcacggatcatgttgatcggtgtgttagaacctaaagacttagaaaggatatcagcaacgccagcaagctcaagtaccgcacgtacagggcctccagcgataactccagtaccttcagaagcaggtttcaacaagatattgcctgcaccgaaacgtccgatgatttcgtgtggaatcgtagttccaaccattggtacttcaatcaaattctttttcgcatcttcaacagctttgcggattgcttcaggtacttcttgtgctttaccagtaccgaaacctacgtgaccgtttttgtcaccgacaacgactagagctgcgaaacggaaacgacgaccacctttaacaactttcgctacgcggttaaccgtaactaagcgttcttctaactctaatttgcttgggtcaatacgacgcataatcatgtgtccctcctttttttattaaaatttcagtccggcttcacgagctgcatcggccagagcttttacacgtccatggtataagtatccgccgcggtcaaatactacgtcagaaacacctttctcagaagcgcgtttcgcaacgagttcaccgactttagcagcagcagcgctgtcaccagtgctttccacgttcaaatctttatcaagagtagaggcactagcaagtgtaacgccatttacatcatcgatgatttgagcataaatgtgtttgtttgaacggaacacattcagacgaggtctttcagctgtgcctgaaagtttagcacgaacacgggcatgtcttttttgacgagcagcatttttgctagttttcgtaatcatccttaggtcactcctttcttcactttaagcggtcttacttagcagatttaccttctttacggcgaacaacttcaccttcgtagcggattcctttacctttgtaaggctctggagaacgtacagcgcggatgttagcagcgatagctcctacacgctctttgtctgtaccttttacaactactttagtttgagaaggaacttcgatttcgatgccctcttcaggaacgatctcaacagggtgagagtatccaacgtttaaaacaagtttgtttccggatttagccgcacgataaccgacaccgactaattccaaacctctttcaaatcctttagatacgccttcaaccatgtttccaagcagactgcgagtcgtaccatgcagcgcacggtgctctttgtgatcagaaggacgagtaactgtaagcacgttgtcctcaattttgatttccatatcaggatggaaagtacgagttaattctccttttggtccttttacagctacagtgttgccttcgttcagcgttactgtaactccagaagggatctcaagcagttttttacctacacgagacatactaaaacacctccattcttgttaaacttcttaccaaacgtatgctagaacttctccaccagcttgttttgcacgggcttctttgtccgttaaaacaccttgtgatgtagaaataatcgcgattccaagaccgttaagtacgcgaggtacttcatttgatttagcgtatacacgcaaacctggtttgctgattcttttaagaccagtgataacgcgctcgttgttttgtccgtatttcaagaaaacgcggatgataccttgtttgctgtcttctacgaactcaacgtcacgaatgaaaccttcacgctttaaaatgtcagcaatttctcttttcaatttagaagcaggaatttcaagcttctcatgacgtaccatgtttgcattgcgaatacgagtcagcatatctgcaattggatctgtcataaccattatataattacctccttcccattcttggggattaccagctggcttttttcacgccaggaatttgtcctttatatgcaagctcacggaaacaaatacggcaaagtttaaatttacgaatgactgagtgcggacgtccgcagcgttcacagcgagtgtactcttgcactttaaactttggtgtacgttgttgtttcgcaatcattgactttttagccacgatttcgcctccctttcattgattatttctggaacggcatacctacttgagttaatagctcacgagcctcttcgtcagagttagcagtcgttacgataacgatgtccattccgcgaacctttgttactttatcgtagtcaatttcagggaagattaactgttctttgataccaagagtgtagtttccgcgaccgtcgaaagatttcttagaaatcccgcggaagtcacgtacacgcggtaaagatacagaaataagtttatcaaggaaatcatacatgcgctctccgcgaagagttactttcgcaccgataggcattccctcacgaagacggaatccagcaattgatttcttcgcacgagtaacgacaggtttttgacctgcgataaacgttaattcttcaacagcactgtcgattgcttttgcgttttgaacagcatcaccgacacccatgttgattacgattttttcgatttttggcacctgcataacagagtcgtagttgaacttcgtcattaaagcaggtgaaatttctttattgtacttttctttaaggcggttcatgagatagacctcccttcctttaaatactatttatctaagacttgcccagatttttttgcaacacgaacttttttgccatcttccactttgtatcctacgcgagtcacttcaccagttttaggatcgagcggcataacgtttgatacatgaattggcgcctcttgattagaaataccgccttgagggtttgcttgagttggtttagagtgcttcttcaccatgtttacgccctcaactagaacgcggtcctttttagggaaagcagcaaggatcgtaccttgtttgcctttatctttaccagagataaccattactttatcgccttttttcacatgcatcctgatcgcacctccttgagtaaggcatttatttcattagataacttctggagccagagaaacaattttcatgaagttgttttcacgtaattcacgggcaaccggtccgaagatacgagttccacgcgggctcttgtcgtcacggatgataacacatgcattctcatcgaagctgatgtatgatccgtcagatctgcgtgctccgctttttgtgcgaacgataacagctcttacgacttcaccttttttgacaacgcctcctggtgttgcttgtttaaccgtgcaaacaattacatcaccaatgttagccgttttacgtccagaaccgccaagaactttaatagtaagtacctcacgcgcaccggagttgtcagcaacttttaaacgagtctcttgttgaatcattatttgttacctcccttcggaaaaagaattccgaactttattagataataacagcttcttcgacaacttctactagacgaaaacgcttagttgcagataatggacgagtttccatgatctttacgatgtctccgattttagcttggttattttcatcatgtgctttgaatttctttgagtattttacgcgtttaccgtaaataggatcctttttgtatgtttcaacaacaacagtgatggttttatccattttgtcagaaacaacacggccttggtaaactttgcgttggttacgttcgctcatgctcacgacctcccctcagtgattatttgttggcagcaatttctctttcacgaatcacagttttcatgcgcgcgatagctttgcgcacttcacgaatgcgagcagtattttcaagttgtcctgtcgctaattgaaagcgaagattgaaaagttcttctttaagagactttactttttgttcaatttcagcagtggtaaggtcacgaatttcattagctttcatttgattcaccaccaatttcttcacgttttacgaacttcgttttaattggcaatttgtgagatgcaagacggagagcttcacgagctacctcttcagacacaccagaaatttcaaataaaactttgcccggttttacaacagctacccagccttcaggagcccctttaccggaacccatccgtacctcaagcggtttagcagtgtaaggttttgaagggaaaattttaatccaaactttaccgccacgtttcatgtaacgagtcatcgcaatacgtgcagcttcgatttggcggttcgtgatccaagaagcttcaagagcctggataccgtactcaccaaaatgtacttcagtaccgcctttagcgcgaccgcgcatttttccgcgatgctctctgcgatatttaacgcgttttggtaataacatattattttcctccttcctcagttttcttcttagtaggaagaacctctccacgatagatccagacttttacaccaagcttaccgtaagttgtgtcagcttcagatgttgcatagtcgatgtcagcacgtaaagtgtgcaatggaacagttccttcactgtagtattcagaacgagcgatatcagctccgccaagacggccggaaaccattgttttcacaccttgtgctccagcacgcatagtgcgttggatttgttgtttctgcgcacggcggaaagaaatacggttttctagttgacgagcgatgttgtcagctacaagctgagcatcaagatctgctcttttgatttcaagaatgttaatgtgtacacgcttgccagtaaggctgttaagggctttacgaagtgcttcaacttcagatccgcctttaccgattaccataccaggcttagcagtgtggatcgtaatgttaacgcggtttgctgcacgctcgatttctactttagaaacagaagcgtcagaaaggcgtttgctaatgaattcacgaatttttaaatcttcgtgcaggaagtcagcgtaatctttaccagcgtaccacttagattcccaatcacgaatgactccgatacgaagaccgactggatttaccttttgacccactacttatccctccttcttttctgatacaacgattgtaatgtggctcgtacgtttgttgatttggctcgcacgtcccatagcacgcgggcggaatctttttaacgttgggccttcgtcaacaaatgcctgagaaataaccagattgttagcgtccatctcgtagttgtgctcagcatttgcgatagcagattttaaaactttttcgatgatcggagaagcagctctcggagttaggttcaagatagatactgcttcgcctacttgcttacctcgaatcaggtccattactagacgtgctttacgaggagcaatacggactgttcttgcaacagctttagcttgcatttaaaagcctcctctcttagcgtcttgtttttttatcgtcactggcgtggcctttgtaagtacgagtcggtgcgaattcgcccaacttgtggcctaccatgtcttcagaaatgaatacaggcacgtgtttacgtccgtcatatactgcgatagtgtgaccgataaattgtgggaaaatagttgaacggcgagaccaagtttttacaacttgtttcttgtccgtttcatttaatttctcgatttttgtcatcaagtgtccatcgacaaatggtccttttttcaagctgcgagccattttggaacctcccttcgtgattgcactacggtccgaaatgaaccgtagacaaccccgttatttatttttacgacgacgtacgataaatttatcagatttgttctttttcttacgtgtcttgaatccaagagtcggtttgccccaaggagacattggtgatttacgtccgattggcgcgcgaccttcaccaccaccgtgcgggtgatcgttagggttcattacagaaccgcggactgtagggcggatgcctttccagcgagagcgtcctgctttaccaacgttgataagttcgtgctgctcgttacctacttgaccgatagaagcgcggcaagcagaaaggatcatgcgaacttcaccagagttaagacgtacaagaacgtatttgccttctttaccaagaacctgagcagatgtaccagctgaacgtacaagctgtccgcctttaccaggttttaattcaatgttatgcacaactgtaccaacagggatgttgataagcggaagtgcgttacctactttgatgtcagcttcagggccggacatgatttcagtacctacttgaattccttttggagcaagaatgtaacgtttttctccgtctacatagttgattagtgcaatgttagctgaacggtttggatcgtactcaactgtagcaacgcgtccaggtataccatctttatcgcgtttgaagtcgataacacggtattggcgtttgtgtccgccaccttggtgacgtacagtcaatttaccttggttgttacgtccgccttttttgtgaaggggcgcaagcaaggatttttccggctggtcagtcgtgatttcagcaaaatctgaagttgtcatgccacgacgtccgttagaggtcggtttatactttttaatcgccattttgaatttccctccttctttttacagataattaagcttcaaaaatttcgatttctttgctgtctgcagtaagttttacgatcgcttttctgcgacggctagtcataccagtatagcggccgacacgttttgatttccctttgtagttcatgatgttgactttgtcaactttcactccaaagatactttcaactgcatctttcacttctgttttattagctcttacatcaacttcaaaagtatatttcttttcagtcattaaatcagcagaacgttcagtaatgacggggcgcttaagaacatcacgaggatctttcattatgcaagcacctcctctactttttcaaccgcagcttttgtaatcagaagcttctcgtggttgacaacgtctaacacgttgattccgttagcttgaacaactgtaactccagggatgttgcgtgcagaaagagatactgcttcgtttgcatccgcagttacgattaaagcttttttctcaacagataatcctttaaggacagctgccatttcttttgttttaaccgtatcaagagtaagatcttcaagaacaataatgttgttgtcgttcactttagaagacaatactgatttgattgccaagcggcgaacttttttaggtaatttgtaagaatagctgcgtggtgttgggccgaatacgacaccacctccgcgccattgcggtgaacggattgaaccttgacgggcacgacctgtacctttttgacgccatggtttgcgacctccgccgcgtacttcagaacgattttttactttgtgagatccttgacgtaaggaagctctttgcataagaatagcgtcgaatactacgctctcatttggctcaattccaaatacagaagcgtttaattcgatatcaccagcagtagaaccgttttggttgtataatgctacttttggcatgatcaatttcctcctttcctaagagacttatttagatttaacagcacttttaacagtgattaaagcttttctcgcaccaggtacgttacctttaatcaaaagaagattgcgctcagcatctacttttacgacttcaaggttttggacagtgatttgatctccgcccatgcgtccaggtaatagtttacctttgaatacacggttaggatctacaggtcccattgaaccaggacgacggtggtagcgtgaaccgtgagacataggtccgcgagattgtccgtggcgcttgattgcaccttggaaacctttacctttagatactcctgttacatctacgatttctcctgcagagaaaatttcaaccttgacttcctgaccaatttcatacgcatccatatccacgccgcgtaattctttaacgaagcgcttaggagcagtttccgcttttgcaacgtgtcctttttccggtttgtttgaaagcttttcgcgcttatcgtcaaaaccaagctggatcgcttcatagccatcattttcagctgttttcttttgaagaacaacgtttggagctgcttcaataacagttaccgggataagatcaccgttctctgcgaatacttgcgtcataccaatttttcttcctaagattcctttggtcattcgtcacacctcctattaagatcattctatattttagaattaaagtttgatttcgatatcgacaccagatggtaagtctaatcgcatgagagcatcaacagtttgtggtgttgggttcacaatgtcgattaaacgtttatgtgtacgcatttcaaattgctcacgagaatctttgtatttgtgcaccgcacgaaggattgtgtaaactgatttttcagtcggcaacggaatcggaccagatacgctggcaccagaacgttttgccgtttcaacaatcttctctgcagattgatcaaggattctatgatcatatgcttttaaacgaatacgaattttttgttttgccattattttccctccttttcgcctacatcacgttagacagttctccgtgagaaaaacctgatcaccttgccatggcaaagcggccgggtgtgtcagcaacctctcacttcatcgcagtcaaagaccaacatacactattatacagaaaatagacgcatgttgcaaggtttatttaaagaaccttgtggttttcacactttgattattatacaggtgataccatgattaatcaaggatatgactgttttctttcagagatggaacgatgcgaaccggctgacaacttcggcaaagcgatccggttcctccaagtgaggcgaatgggctgagttctcaaaccaatgccattctttatacggcgcatcaaccttctgataatattcataagacgtcgtccccggaaccgtcaaatcgtatctccctgacataaaacagcacggtattacaatagaagaaactgattcccctgcatcaaaggaaatgagatcctcccacaggtgtttcaggctgaacatttgtccccgcgcggctaagaagctccctctcacaccgtacggttcaccaaacagcattcgcccccctgctttaagagcgccgatcggatgatgggtaaagccccctcccctcatttcaatacaaagcagaaacagcgttcgctgcagctgtttctcccatgggggtgctccgataaagctcagcgtcttgcccagcaggatatgtttgtgttgcctgctccattccatcatcaaccggtaggcttccgtttcttccttttgaatattaaccacctgactgataccgatatacgcataatacaaatcaggtttctcttgaagaacttgaagcgccaaaactgaaccccacgaatagccggcgatatatatttttctcctgctgaattgcttgcataagcgttcggtcagatgaatggtgtcagctgtcagctgatccaaagtcatagatgaacccggaatttcctttgaataagagagacccgcccctctctgatcccagttcacaacggtgaaatgcttttccagctcattctggtattttctcgcataaccgatttgaggcgtgccgggaccgccatgcaaaaacaaaagcagcggactactcctgtcatcaccattaatcataatggtttgttcactgccattaatctgcaattgctgaagcattgaaatacgattggttttcttgaagttatcgttcatcggtctgctcctaaaatttgtatacgttctattatacatggaatcagcagggaaacaaaaaaacgaggccccataagggaccccgcattattgaacgagtcgattactcagtgattgtagaaacaacgcctgaaccaactgtacgtccgccttcacgaatagagaaacgagttccttcttcgatagcgattgtagagataagttcaacgatcatttcagtgttatctccaggcataaccatttctacgccttctggaagattgatgataccagttacgtcagttgtacggaagtagaactgaggacggtagttagagaagaatggagtatgacgtccaccctcttctttagaaagaacgtaaacttcagctttgaatttgctgtgtggagtgattgtacctggtttagcaagtacttgtccacgttggatgtcttcacgagctacaccgcgaagaagtgcaccgatgttgtctccagcttcagcgtagtcaagaagcttacggaacatttcaacacctgtaacagttgttttgctgttttcttcttgaagaccgatgatttcaacttcgtcaccgactttaacttgtccgcgttctacacggccagtagcaactgtaccacgaccagtgattgagaatacgtcctcaactggcatcatgaatggtttttcagtgtcgcgttctggagttgggatgtactcatcaactgcagccataagttcaagaattttttcttcgtactcagcatcgccttcaagagctttaagagcagaacctttaacaactggtacatcatcaccagggaagtcgtattcgctaagaagatcgcgaacttccatttcaacaagctcaagaagctcttcgtcgtctaccatgtcgcatttgttaaggaatactacgatgtatggtacaccaacgtttttagaaagaaggatgtgctcacgagtttgtggcattgggccatcagcagcagatactacaaggatagctccgtccatttgcgcagcaccagtgatcatgtttttaacatagtcagcgtgtcctgggcagtcaacgtgtgcatagtgacgagtgtcagtttcgtactcaacgtgtgcagtagagattgtgataccgcgctcacgttcttctggagcaccatcaatttgatcgtacgccatagctgtacctttaccagatttcttatgaagtactgttgagatagcagcagttaatgttgttttaccatggtcaacgtgtccaattgtaccgatattggcatgtgatttggaacggtcgaatttttctttagccattctaaaatcctccttaagagcttttaattagtaatgtatagagtgatagaaagtgaaagcaagctctcacttcctcatcttacaatagtagttatacttgagttaagtggcaaaatcaattattcgcctttattttttttgataatttcttcagcgatgctcttcggcacttcttcgtagtgatccatgaacattgtgaacgtaccgcgtccttgcgtgttagaacgaagggcagtagcgtaaccgaacatttcagcaagaggtaccatcgcacgcacaacttgagcgttaccgcgagcttccataccttctacgcgtccgcgacgagaagtaacatcacccatgatgtctcccatgtattcttcaggaataacaacttcaactttcatgattggttcaagaagaactgggttacatttgctgactgcatttttcaatgccatagaagcagcgactttaaacgccatttcgtttgagtcaacatcatggtaagatccatcaaaaagtttcgccttgatgtcgattagcgggaatccggctaggacaccattttcaagagagtcttcaagacctgcttgtacggctgggatgtattcacgaggaacaacaccaccgacgattgcgttttcgaattcaaagccagcgccttcttcgttcggttcaaattcgatccaaacgtgaccgaactgaccgcgtccgcctgattgacgtacgaatttaccttcaacttttgcaccggtacggaatgtctcacggtacgcaacttgaggagcaccaacgttagcttcaactttgaactcacgcttcatacgatcaacaatgatatcaaggtgaagctcacccataccagagatgattgtttgacccgtttcagggttagtttgtgtacggaatgtaggatcttcttcagcaagtttcgctaaagcgatacccattttatcttggtcagcttttgatttaggctcaatcgctacgtcgataacaggctctgggaattccattgattcaaggattacaagatccttttcatcacacagagtatctccagtagaagtatcttttagacctacagcagctgcgatgtctccagcgtaaacagtagagatctcttcacggctgttagcgtgcatttgaaggatacgtcctacgcgctcacgcttgccttttgtagagttctttacatatgaaccggaatcaagtgtaccggaatatacgcggaagaatgtcagcttaccgacataagggtcagtcataactttaaatgcaagtgcagagaacggctcttcatcagaagaatgacgaacgatctcttcatctgtatcaggacgaacacctttgattgcagcaacatcagttggcgcaggaaggtagtcaagaacagcatcaagtacaagctgaacacctttgtttttgaaagcagaaccaacaagtacagggtagaattcaacattcagtgtacctttacggatagcagctttcagttcagggatagtgatttcttcaccttcaaggtacttttccataagctcttcatcaagctcagctacagcttcaatcaggctgctgcgaagctcttcagcttgctctttgtactcttcagggatttctttcgcatctgaacgagttccaaggtcatcttcgtagaaatacgcaacgttttctactaagtcgatgataccttcgaagttgtcttcagcgccgatcggcaattgaattgcgtgagcgttagcttgaagacggtctcttaaagtgcctacagagtaaaggaagtctgcgccgattttgtccattttgttgacaaatacaacgcgcggtactccgtaagttgttgcttggcgccatactgtttctgtctgaggctcaacacctgattgagcatcaagtacggcaaccgcaccatcaagtacacggagtgaacgttcaacttcaactgtgaagtctacgtgtcccggtgtatcgatgatgtttacacggtaacctttccactgtgcagtcgttgctgcagaagtgattgtgataccgcgctcttgttcctgctccatccagtccatttgcgaagcaccttcgtgagtttcgccaattttgtggatacggcctgtgtagaacaagatccgttctgtagtagtcgttttaccggcatcgatgtgagccatgatcccgatattacgagttttttctaaggagaactctcttgccattgggtaatttctccttccttattagggaattattattttgattatatgaatcctaccagcggtagtgagcaaatgctttgttcgcttctgccatcttgtgagtgtcttcacgtttcttaacggcagcaccagtgttgttagctgcatcaagaatttcgttagccaggcgctcttccattgttttttctccgcgaagacgcgcatagttaaccaaccagcgaagaccaagagttgtacggcgttcaggacgaacttctacaggcacttggtagttagctccacctacacggcgtgcttttacttcaagtacaggcatgatgtttttcaatgcttgttcgaaaacctccattgcatcattgccagtgcgttctttaatgatatcgaatgacttgtataggattgtttgagatttaccttttttaccgtcgatcatcattttgttgatcaggcgggataccagcttagagttgtaaagcggatcaggtaaaacatctctttttgctacaggacctttacgtggcatctgaatatcctcccttcatagttttaatgatttattattattactttgctttaggacgtttcgtaccgtatttagaacggccttgcgcacggttttcaactccggcagtatcaagcgcgccacgaacgatgtggtagcgtacccccggtaagtcttttacacgtccgccgcggatcagtacaacgctgtgctcttgcaggttgtgaccgataccaggaatgtaggcagtaacctcgattccgttagtcaaacgaacacgagcatatttacgaagtgctgagttcggttttttcggtgtcattgtaccgacacgagtacataccccgcgtttttgtggagaagatacgttagtgtgctcttttttaaagctgttgtatcctttgtttagtgcaggtgacttagagttttcaactttgctcacgcgtcccttgcgaattagctgattaattgtaggcatgttgtgttcctcccttcattacgttttataacccacatacccaggtggttcatcattaggcaaaaaaacaatgtctttacataagattgatatcttatataaaaacaaaaagtacgctataacataatggcaacagctgctgctcccacttcaattccgcaggctttgccgagctttttcatggaatccaccatacagacagcggtattttggttctttgcaagctggataacgccagccgtaagaactgaatccgcgtcttttgccacgacgacttccttcactgaacctcgttttagagctttcactgtttgcttcgtaccaataataattgatttggcctgtgatactttatcataagacataaacatatcctccaaagtaacaggttttatttcgagcaccttggttatattatcactctgcgggacggatgtcaacaacgtatgacattttttagtgcagtcccccgccagaataattgtaatactgaggaaaagctgtcgaaacagcctttcctgcagcagtttctgttattcagccggaaccatatcttccgaaggctgaacgtttgaaacaggttttacttttctgtaattcatcatacctgtaccggccggaaccagtttaccgatgatgacattctctttcaggccgagaagttcatcacgcttgcctttaatcgcagcatctgtaagaacgcgtgttgtttcctggaatgatgcggcagacaagaatgaatccgtctcaagtgaagctttcgtgataccgagaaggacaggacggcctgtagcaggtcgattgccttcaagcagcacttttttgttcgcttctgtaaattggtgaatatcaagcaatgtgccagggagaacatcagtatctccggcatcgattacacggactttgcgaagcatctggcgaaccattacttctacgtgtttatcgccgatttcaaccccctgcatacggtaaaccttctgaacctcatgcagaagatattcctgaaccgttgtcaggtcagtaactttaagaagttctttcggatcgattgaaccttccgtcagcacttgaccgcgggtaatctgatcaccctcagtcactttcaggcgtgagttgtaaggtgccgtgtatgaacgggtctcaacagcaccctgaacaacaatctcctgctgtttgtcgcggacttcattgatttcggcaattgtaccgtcaatctcagaaatcgtcgcttgacctttcggattacgcgcttcgaaaagctcctggatacgcggaagaccttgtgtgatatcgtctccggcaaccccgcctgtgtggaacgtacgcatcgttaactgtgttccaggctcaccgatagattgagcggcgataatacctactgcttcgccgacttcaacatcagttccggttgcaaggtttcgtccgtagcatcgtttacatacaccatgaggagtgttacatgtgaacgcagaacggatccacacttcttcgattccggcttcaacgatttccagcgctttatcttcatcgatcaattcattttcgttaatgagcacagcacccgtttcaggatgtttgatctgttttctggcgaaacgtccgatcagacgctcttccagacgctcgatgatttccgtgccttctttgagcggttttgcaagaataccgcggtctgttccgcaatctgtttcacgaatgataacatcctgcgcaacatcaacaagacggcgtgtaaggtaacctgagtcagctgttttcagggcggtatcggcaagacctttacgcgcaccgtgagtggagataaagtactccaatactgtcagaccttcacggaaacttgatttaatcggcaattcaatgattcgtccagccgggttggccatcagaccgcgcatacccgcaagctgtgtaaagttagatgcgttaccacgggctcctgaatcactcatcatgtagatcgggttgacttcgtctaatgatttcatcagtttgccttggataacatctttcgctgaactccaaattgaaatgactctttcataacgttcttcttcggtgattaaaccgcgtctgaactgtttcagaacattatctactttgctttgtgcttcttcaaggatttcctgtttatcatcgagaacgacgatatcagaaacccctactgtgatgccggctttcgttgaatatctgaaaccgaggtttttcatgcggtcaagcattttagacgtttccgtgatatggaatcgtttaaagatttccgcgatgattttacccaaaataccttttttaaacggtgcgttgatcggctgctcagcaatcacagcttttacgtcagcacctttatctaagaagaaacggtcaggtgtcttctcttcaatgttgctcttcgttggttcattcatgtaagggaatgattccggaagaatttcattgaagacgagcttaccgacagttgtaattaacaattttgaacgctgttcttcagtaaatgtcacattcttaagggagttcgctgcaacagctactctcgtatgaagatgaacataaccgttttgataagcaagaagcgcttcgtccgtatttttgaaaaccataccctcgccgactgctccggcgcgctcaagcgtcaggtagtagtttcctaataccatatcctgagacggcgtaacaaccggtttaccatctttagggttcaagatgttttgggccgcaagcatcagaatgcgcgcctcagcttgagcctcagctgataaaggtacgtgaaccgccatttggtcaccgtcaaagtcagcgttataagctgtacatactaacgggtgaagacggatggcgcgtccttcaacaagcgtcggttcgaaagcctggatacctaatctgtgaagagtaggggcacggttcagtaagaccggatgctccttaatgacagattcaagtacatcccatacttcaggctgcacgcgttcgattttgcgttttgcgctcttgatattgtgagcaaggcctttttcaacaagctctttcatgacgaaaggcttgaagagctcaagcgccatttccttcggcaaaccgcactgatacattttcagatgcggacctacgacgataacggaacggcctgagtagtctacacgtttaccgagaaggttctgacggaaacgcccttgtttccctttcagcatgtgagaaagagatttaagcggacggttacccggtccggtaaccggacggccgcggcgtccgttgtcaatcagagcgtcgactgcttcctgaagcatacgtttttcgttctgaacgatgatgcttggcgcgccgaggtctaacagacgttttaaacggttattacggttgatgacacgacggtaaaggtcgttcaggtcagacgttgcgaaacgtccgccgtcaagctgaaccatcggtcttaattcaggcggaataaccggaagcacgtcgagaatcatccaagacggcttgtttcctgaattacggaaggcttcaagcacttcaaggcgtttgatcgcgcgtgtacggcgctgtccttgagaagtcttcagctcttcttttaacatatcaacttctttgacaaggtcgatgtcctgcagaagtttattaatggcttccgcacccatagaggcttggaatttgtttccgtacttatccagatacgcacggtattccttttcagataaaagctgtttcttttcgagcggtgtattggccgggtcagttacgacgtaagaagcaaagtaaataacttcttccagcgcacgcggtgacatatccaatacaagacccatacggctcggaatacctttgaaataccaaatgtgagaaaccggggcagccagttcaatatgccccattctctcacgacggactttagcccgcgttacttcaactccgcaacggtcacaaactacgcctttataacgaacccgcttgtacttgccgcaatgacattcccagtccttagtcggtccgaaaatgcgttcgcagaacaggccgtccttttcaggtttcaacgtacgatagtttatcgtttcaggctttttcacttcaccaaaagaccatgaacggattttatccggtgaagcaagaccgatgttcatatactcaaaattgttcacatctagcaaggggcctacctccctttttatcttcggattaaccgatgtcacttgcctttatcaatcagagactattctttcgttactgcgtcacgttcaacgtctggagatgctgtttcttccggcgcttcatcacctgataatgcaaggccgtcagcctgtttcgcatcttcctcgtcttctagatctctcatttctatttcttcttcatcgcctgagaggatttttacgtccatacctaagctttgaagctctttgatcaatactttgaatgattccggaacaccaggctctggaacattgtcgcctttgacgatggcttcatatgttttcacacgtccgaccacgtcatcggacttcacagtcaggatttcttgaagcgtgtaagctgcgccgtaagcttcaagcgcccaaacctccatctcaccgaaacgctgtccgccgaattgggctttaccgccgagaggctgctgcgtaacaagtgagtaaggacctgtagaacgggcatgaagtttatcgtcaaccatgtgagccagtttgatcatgtacatgattccgactgatacacggttgtcgaacggttctcccgtacggccgtcataaagaactgttttagcgtctcttgacatgcctgcttcttcaagtgtttcccacacatcttcttcacgcgcgccgtcaaatacaggtgacgcgatgtgaatgccgaggtagcgggcagccatacccatgtgaagttctaatacctgaccgatattcatacgtgatggtacacccagcgggttaagcatgatatcgatcggcgtgccgtcaggaaggtaaggcatatcttcttcaggaagaatcttcgagataacccctttatttccgtgacgtccggccattttatcaccttcagaaatcttacgtttctgaacgatatatacgcgtacaagctggttcactcccggaggaagttcgtcgccgtcttcacggttgaagacttttacgtcgtggataattccgccgccgccgtgaggcacacggagagaagtatcacggacttcacgcgctttttctccaaagatcgcatgaagaaggcgttcttcagccgtaagctcagttacacctttaggcgttactttacctacgagaaggtctccgtcgttgacttccgcgccgatacggataattccgcggtcatcaaggttgcgaagcgcgtcttcccctacgtttggaatatcgcgggtgatctcttccggcccaagctttgtatcacgtgcttctgattcatattcttcaatgtgaatagatgtgtatacatcatctttcacaaggcgttcactcatgatgatggcatcctcatagttgtaaccgtcccatgtcatgaagccgaccattacgttgcggccgagagcaagttcaccaagctccattgaaggtccgtcagcaaggatttctcctttgactacttcatcgccgacacttacaatcggacgctggttgtagcacgtaccttggttggagcggacaaatttcagcaagctgtacttatccaggttgccttttactttttggccgtcaatttcttcatagcggcgcacccatacgtttttcgcttccacccgttctacgataccagggtgtttacaaataacggctgcaccggagtctttaccggatacgtattccatacccgttccgacgatcggagcttccggctgcatcaaaggcacagcctgacgctgcatgttcgctcccatgagggcgcggttcgagtcatcgttttccaagaacggaatacatgctgtcgcagcagaaacaacctgtttaggagatacgtccatgtaatccacgcggttgcgggctacaacggtgttttcccctctgaaacgcgctacgatgctgtcatccaagaaagaaccgtcatcgctcagcttagcattcgcttgggctacgacatagttatcctcttcatcagcagtcaggtagtcgattctaggcgttacttttcctgtttcaggatcaacgcggcggtatggcgtctcaatgaaaccaaagcggtttactttcgcaaatgatgacaatgagttgatcaaaccgatgttcgggccctcaggcgtttcaatcggacacatacggccgtagtgagagtagtgaacgtcacgtacttccatacctgcgcgctcacgcgtcaaaccgcccggtccgagagctgacagacggcgtttgtgcgtcaattcagcaagcgggttcgtctgatccatgaattgagaaagctgtgagcttccgaagaactctttaatagacgcaataacaggtctgatgttaatcagctgctgcggcgtaattgtattcgtgtcttgaatagacattctttcacgtacgacacgttccatccggcttaaaccgatacggaattggttttgcaggagctcacctacagaacgcagacggcggtttccgagatggtcgatatcatcagtgtcgcccactccgtgcaggaggttgaagaagtagctgatagaagaaataatatcagcaggcgtaatgtttttaatcgcctcttcgatgtaagcattgccgatcacattgatcgtctgctctccttctgcatcagtaggagcatagattttaatggattgaagcatcacttcatcctcgacaacgccgccgttaggataaagttttctgaagccgattccattttctaagtatggcaatactttatcaagtgttcttctgtcaagaatctgccctttttcagcgagaatttcaccggtttccggatccaccagtgtttctgcaaggcgctggttaaacaggcggttcttgatatgaagctttttattaattttatagcgtcctacattcgcaaggtcgtatcgcttcggatcgaagaaacgggaatccagcaagctttttgcgttttctactgtaggcggctctccgggacgaaggcgctcatagatttcaagaagcgctttgtcactgttttcggtgttgtccttatccagtgtattgcggagatattcgttctcaccaatgagatcgagaatctcttggtcggaaccgaagccgagagcacgcaaaagaaccgtaaccggcaacttacgtgtgcgatcaatgcggacatacacaacatctttcgcatcagtttcgtattctaaccatgcgccacggtttggaatgacagtcgcggtaaaaccttttttaccgtttttgtctactttaccactgaaatatacacttggagaccgaacaagctgagatacgataacacgttctgcaccgttgatgataaaagtaccggtatctgtcataatagggaaatcacccatgaagacatcctggtcttttacctctccagtttctttgttaattaaacgaaccttcactcttagcggagctgagtaagtcacatcacgttcttttgactcttcaacgggatacttaggatctcctaaactgtagtcaatgaactctagagagaggttaccagtgaaatcctcaattggtgatatgtcttgaaacatctctctaagaccctcatcaagaaaccactgataagaagaggtttgaatttcaatgagatttggtaattctaacacttcgctaatgcgagcatagcttctgcgctggcggtgtcgtccatactgaactagttgacctgtcaactgattcacccctcaaatcatgcgtattatatgtgtaataagcatctcttacgataaagaaatacttttacaagacaaaagaaaaaagggtttctaattaagaaaaccacatccaaaaacaaataccgattttattagcatttccatgtttgtataatttatacatgcactatgattatttgagcatatcatgcaaaatatatacattggcattttacaatattaacatagctgaaaattcaagtcaaactttttttgcttttatgatataatagcctttctttttttgaaccacagaaacttcgtcaaaaagctccttcagtttttcaatggcagaaggcccgccctgttttttctgtataacgatccacaattcacctgaagcccttaaatgctcagcgcttttttcaaaaatggcatggacaactttttttccggcgcggattggggggtttgtaataatagaagcaaatgtttgagcagaatcaatatttgaaaataaatcactctgataaatccgaacgttttttattccgtttttttctgcattttcatttgacagctctacggctctttcattcacgtcaatcatgtgcacggtccggtctgtaaatgcaccggcgagcgacagaccgatcgggccgtaaccgcagcctgcatccaggaagtcaccatcgatctccggctcttcaaacgcttcaattaagacacgcgaaccgaaatcaacttcctttttcgagaaaacgccgctgtcacttgtgaatgtataagatctgttccgcagtgtaaatgaccatgtctgtttatcgcttttaactgaaggtttttctgaataatagtgttcactcattattagaacctccttttttaattgcacttaaagaaaagcaaagaaaaagcccgcctcataaaagcgagcttcccctacaggcaagtgaagattacttaacttctacagaagcgccaacttcttcaagtttagctttaagctcttcagcttcttctttcgcaataccttctttaagtggttttggagtgttgtcaacaagttctttagcttctttcaagccaagaccagtgatttcacgaacaactttgataactttgattttctgagaacctgcaccagcaaggataaggtcgaattcgctttgctcttcagcagcgccgccagcagcagctccgccagctacagctacaggagcagcagcagttacgccaaattcttcttcgattgcttttactaggtcgttcaattcaagtacagttgcttctttaacggaagcaatgatttcttcgatatttaaagccatttgaaattcctccatttgttttattttagggtaaaatcagattaagcgccttgttcttccttttggtctgcaactgctttagctgcaagtgcaaggttgcgaactggagcttgaagtacgctaagcaacatagaaagtaagccatcgcgtgaaggaagttcagcaagagctttcacttcttcaacagaagatacttttccttcgataacgcccgctttgatttccagagcttcgtgatttttcgcgaactcgttaagaacttttgccggagcgacaacatcttcagtactgaatgcgatcgcattcggtccagttaagacatcattcaaaccatcaagttcagcttgttcaaccgcacggcgagtcattgtgtttttgtacactttgaactctacgttagcttcgcgaagctgtttacggagttcagttacttcagaaacgttaagtccgcggtagtcaacgatgatcgttgatttgctttctttcagtttagaagcaatctcttcaacaacaactttttttgtatcaattgcgctgctcatggttacacctcctgtagattttgtgtaacacttataccgctaggtgatcacgactgtgacgacgatttcatataaaaagcctccatgtggacatggaggctgtatatacaagcatacgtaacgtaatagctgtgatatatatacacctcggcaggatattaagcctcaacggcccctgctgtctacggtataaatgacatattatattttacaacattttgaatcatatcagaatgctgatctaaagtcaaatattattttacgttgaaagtagaagcgtctactttgacaccagggcccatagtagaagtaacggcaacgtttttcacgtaaacacctttagccgcagccggttttgctttcaggattgtatcatacattgttgtgaagttctcaacaagtttttcatcctcgaaagaaacttttccgatcggaacatggatgttaccagctttgtcaacgcggtattctactttaccagctttgatttcgccgattgctttttctacttcgaatgtaacagttcctgttttagggtttggcataagaccttttggtccaagcacacggccgattttaccgacttcacccatcatgtcaggagtcgcaacgattacatcgaattcgaaccagccttgctggattttcgcgatgtaatcagaatcaccgacgtagtctgcaccggcagcttcagcttcttttgctttttcgcctttagcgaatacaagcacgcgctgagttttaccagttccgttaggaagtacaactgcaccgcggatttgctgatcgtttttacgagggtcaacccctaaacgaaaagcaacttcaactgtagcgtcgaatttagctgtgtttgtttttttagtaagcgccactgcttcagcgacgtcgtaagctttcgcacggtctacaagcttcgcagcttcaacgtactttttaccttttttagccattttaaaatttcctccttatgtggttatagcggaataacctcccacgaataagggttgcgaacttgtgaaaactcgcaacccgacaagaaacaaattaatcctcgataacgatacccatactgcgggcagtaccttcaaccatgcgcattgccgcttcaacgtctgctgcgtttaagtcaggcattttcgtttcagcgatttcgcgaaccttatcgcgcttaacggttgccactttattacggtttggttcaccagaaccagactcaattccagctgcttttttaagcaatactgcagcaggcggagtttttgtaataaatgtaaatgaacggtcttcgtaaaccgaaatttcaacaggaatgattaaaccagcttggtcagctgtacgagcgttaaactccttacagaatcccatgatatttacaccggcttgacctagtgcaggtccaactggcggcgctgggttagcttttccagcaggaatttgcaattttacaacttttactacttttttagccacgagacacacctccttaagtccgtgatgtggtaatagggtaaaccctcccactcaaggtttcattctttatatgaatgacgaaatatcaagctagctgccttggattagtccaagacgtacctttgctatattatcattaatatatagcaatttcaagttttttcacattacaatttgtcgatctgggtaaattccagctcaaccggcgtttcacggccgaacatgttaacgaatactttcactttgctcttatcataatcaatctcttcaattgatcctgtaaagttggcgaaaggtccgtctatgactttgactgtctcattcaattcaaaatcaatgtcggttttccgctcatccatgcccatccgctttaagatggtttccgcttcgccaggaagaagcggagtcggctttgagcctgaaccggctgatccgacgaatccggtaacgcccggcgtgttgcggaccacataccaggaatcatcagtcatgacgatttcaacaagcacataacccgggaacactttctttttgactacttttttcttgccgttcttaatatcagtctcttcctcttcagggacgacaacgcggaaaattttatcctgcattcccattgattccacacgtttttcaaggttcgcttttactttgttttcataaccggaatacgtatgaacaacataccaattcttttccattctatcaggactctgcagtccttccctccccgcatttaaaaatgaagtgtaaaacaaaaaataggctcagagcctatgaatccttttttcaacacaataaaaaacccgctgaacgggttttggcaaacgatattatgatctattatagcacgtattgctgatcattattcaactattaaacgaattaattgagaaattcctgtatcaaggagggcaaaaaagataacaaaaaagataaccgttgaaatcaccgtgatcgtatagcgcgttaactctttgcctttaggccagctaacctttttcatttctttcccaacatctttaaagaaactcatcatgcgcatgtaaaagacctccacaatttaaaaagcgaacactattttgtttctaaatgagctgtatgtgaattgcaagtgctgcagtacttcttaacttctaaccgctcagccgctgatgcagagcttttcattgtcgtataattacgatttccgcatgttttgcatgccagcgtaatcttttttctcatgtcgttacaccttttcctaaacaatcatttatcttaataaaatagcacagtcagaaaaattctgtcaatatgacacagaaacccgctacagactgatttctcttatttccaaatacttttcaagcttgcgcttcacgcgctgcagggcattatcgattgattttacgtgtcggtttaaatcatctgaaatttcctggtaacttcttccgtccaagtacagaacaagcacctttctctccagatcgctcagcagttctcccattttcatttcgatatcatcaaattcttcctgattaataatcatctcttcaggatttaacgttttagcgcctgaaatgacatcaagcagtgttctgtcagattcttcatcaaaaataggtttgtctaaagaaacataggaatttaaaggaatgtgtttctgacgggtagctgtctttattgcggtaataatctggcgggtaatgcataattctgcaaaagctttaaatgaagtaagcttgtcctctctaaagtctcggatagacttatataagcctatcatcccttcctgtacaatatcttctctgtcggcccctattaaaaaataagaccttgctttcgcccgtacaaaattacggtacttcgtaatcaagtaatctaacgcatcactatccccaacatgaaccttttcaatgacctgctcgtcctccaactggcaaaattgcactttgttgaactttcccttgctgttctgtagattcactgcgatccccccggcgcacgtagatagaaatattatacattaatgggcgaaaaagcgtcaacctaatccagaccgcctcggcgccacttttcaaacgttttcaaaacctcttcggacagctcgattttacccggtggtttttcagaagtgatctttgaaacccgcctttgaatccgccgttctatcgtatccacttccctcagaagctcccgggcggatttgcggagagccccttgtccgaaaatcgcccactgctccgtataatcggaggttgcgacatgaatctgtgtcgcaatattattcagcgcctgggcaagtttctcgatccgctcatccgccgtctcattctcccgtgtaaaaatcacttcgactctgtgattcgtttgttttttctctatgccttttaccagatgtgcgtcaaacaccacaatgactctgattcccgtgtaggactgatattccgccatcttctggatcagtacatctctcgcttcttcaaaactgttcgcttttaaatcctttagctgcggccaagctccaatcatgttgtatccgtctactaacaggatgtccatctgtcattattcccctaaaggattgcgcttccggtagacttcatacatgagaaggccggccgctaccgacgcattcagagacgtgacttttccggccatcggaagtttaatgagaaaatcacatttctctttcacaagccggcccattcctctgccttcgcttccgataacgagcgccaaaggcatcttgccgtccatagagcggtagtcttcccgggcggatgcatccgttccgacgacccaaatcccccgctccttcatttcatcaagtgtccgggcaaggttggtcaccttcacgacgggaatgtgttcaatcgcaccggtcgaagcttttgcgaccgtcgatgtcagtccgaccgctctgcgtttcggaatcacaatgccgtgtgcaccgacagcgtcagccgttctcatgatggaaccgagattatgagggtcttccagctcgtccaatatgagaaagaaaggctgttcgtttctctcttccgctcttttatataattcgtctaattgtgcatattcatatgccgccacctgggcgacaacaccctgatgctgcccctccaccatctgatcgagttttttcctcggtacaaattgaatggtgacgccgcgctttttagcaagctccataacttgctgcgcctgtccttttactgtgttttccgccatccataacttatacagcttgcgatctgactttaacgtctcaatcacagcgttttttcctatgacgtaatcatgttgctgactcatttgttttcctccctgacgtcccgacttgtatagcctcagcaatcagctgattcagtctttcttctcttttctcaagaaaaaggtatccgagtaaagcctcaaaagctgtactatggcggtacgtctgtacatctgtgtttttaggcgtggtccctgatttcgcgtttctgcctcttctcagcacggcttcctcttcctccgtgaaaaaggattcgtcctgaaggcggaacaatatgtctgcctgtgattttgccgatacaatccggctcgccttcttatgaaggtcattcggtttcgtaaagccctgcttaagcaggtgatgccggacgtatatttcaaaaatggcatcacccatataagcaagcgcaagaccgtttaactgctttgaatctttgatttgttcaaattgaagcatccgcttattctccccgcttccagcgagttccctgggctgtgtcttcaagaatgatattcatgcttttcagctgatcgcgaatctggtctgacaaagcgaaatcgcgattgcggcgggcttcatttctcttctcaatcaactcttcaatctcttcgtcgacaagctcttcttcgccgagcgtaagtccgagaacagatccgattctgtcaaacatgctgataaaggctttaatgacgtgatccgccgtattgtcttcctgcatgtagtaattggcgagcttcgccagatcaaaccaaacggaaatcgcattcgccgtattaaaatcatcatccattgcttcttcaaacgaagcgcggtgctcttcgattttagcgagccattcctcatcattgtcagtcagattcgtgctgctaatcaaacgatggtttaaattactgtatgccgtcttgaggcggttaaacgcgttttttgttttctcaagcagctcttccgaatagttgatcgggtggcggtaatgaacggaaagcatgaaaaatctcaaaagctgcgggtcatattgcttaatgatatcgtgcaccaaaacaaagttgccgagcgattttgacattttctcattatcgatattgatatatccgttgtgaagccagtattttgcgaatgtcttgcctgttaatgcttcagattgcgcgatttcgttttcatggtgcgggaatgtcaggtcctgaccgccggcgtgaatatcgatttcgtcacccaaatactttttcaccattgcggagcattcaatatgccagcccgggcggccttttccccaagggctatcccatgaaatttctccgtccttagcagctttccaaagcgcaaagtccagcgcatcctctttcttctcgccgacacggatacgcgcgcctgatctgagttcatcaattgattgctgagatagcttgccgtagccttcgaaggcccttgttttgaaatagacgtcgccttctgattcataagcgtagccttttttaatcagctcgctgacaaattcaataatggcgtccatgttttccatgacccgggggtgaagatccgctttccggcatccgagggcgcccacgtcttcaaaatacgctttaatgaaccgttcagaaacggtcgggacgtcctcgccgagctcgttggccgctttaatcagtttgtcgtcaacatcggtgaaattcgatacgtattgaacatcgtatcctttatactccaaatagttgcgtacggtatcatacacaatcgccggacgagcgtttccgatatgaatatagttgtatacagtaggtccgcacacgtacatttttactttgccttcctcaagaggaacaaatgtttcctttttccgtgtcaatgtattataaagtgtaatggtcatttttggttgatcctttcttttttatcttccagttcagcctgcagttcaaaaatctgctgctccaatgctctaaaccggtcagcaaccggatcgggcaagtcttggtgattgagatcgcgtttgatttttcttccgttctgaatgacgactttccccggtatgccgacaacggtcgaaaagtcgggaacatcacgaagcacaacggagccggcccctactttagaaccctgcccgaccgtaatagagccgagcaccttcgctccggttgcaattaaagcatcatcttttatggtcggatgccgcttccccttttcttttcccgttcccccgagagtgacaccttggaataccgtcacgttattgccgatttcacatgtttcccctatgacgacccccataccgtggtcaatgaaaaaccttctcccgatggtcgcgccgggatggatttcaattccggtaaagaaacgggcaatctgtgatatcaggcgcgccaggaagaaaaatctccgtttatataaagcatgtgcaatccgatgcgcccatatagcatgtaaaccagaataagttaaaacaacttcgaaatagcttcttgctgccggatcttgatcgaacactgtatctatgtcttcttttagcattttaaaaaacacatgcttccccccattctctccccgctccagtctgtttttccgcctataaaaaaagcgcctctgcatgtaaacatgacagagacgcttttaccgcgcggttccactctgtttgaaaaacaagtcaatgttttcccaacttaaaagccggtaacggcggcggccgcctttaaatactgatttccgcagaaatgttcttcaaaggtcttaagggcgcacttctaaaacatgacgcatgaatctctctcagccgatgaagattctttctgtaatggtcattgttttatactcttccctgtcaacaatcgtatatttaaatgcttttcaggcgtctgacggctgtttctctgccgatcagctcaatggcctgcggaagctccggaccgtgtgtctgaccggtaaccgctacacgaatcggcatgaacagctttttgcctttatggcctgtttctttctgaacagctttgattgaggctttgatcagctcaggcgtaaattcttcaagctcttcaagcttcgcagcaaatacgctgagcacttcaggcacctgttcttcttccagaacggcttttgcctcttgattatactcgatctcatctttaaagaacaaatcagtaagctcgacaatttcagcgccgtagctcaattgctcatggtaaagagagattaatttacgaacccattcctgttcttcggcagaaagctcagtgccgacttttcctgctttttgcaggtgcggcagggtcagctcaaccacttgatcaagatccagcgctttgacgtattggttgttgacccatttcagtttatgcatatcaaacagagccggtgacttagacaaacgatttacatcaaaaatttcaatgaattgttctcttgtgaaaagctcttcttcaccgacgggagaccagccgagaagtccgataaagttaaacagcgcttcaggcaggtaacccagctcatcatactgctcaataaactggataattgattcatcacgtttacttaattttttgcggctttcgtttacgataagcgtcatatgtccgaagacaggaatatcccagccgaatgcctggaaaatcatgatctgtttcggtgtatttgaaatgtgatcctcaccgcggagcacgtgcgtcattttcattaagtaatcgtcaatcgcgacggcaaagttatacgtcggtgttccgtcttttttgacgatgacaaagtcgccgatgccgtctgattcaaaagaaatctcgccttttacgatatcgttaaatgcgatgattttcccttccggcacgcggaaacggatgctcggctgtctgccttcggctaaaaactgctcctgctcttcctgagtcaggtttctgtgtttgccggaatagcgcggcatttccccgcgggcgatttgctcttcacgttctttttcaagttcttcttccgtacagaaacatttataagcaagccctttttcaagaagctcttcatagtactctttgtaaatgtcgttacgctcagactggcggtacgggccgtattctccgccgacatccacactttcatcccagtccatgccgagccatttcaaatagttaagctgactttgctctccgccttcaatatttcgctttttgtccgtatcctcaatccggataataaactttccgccttggctgcgggcaaataaatagttaaaaagcgccgttctggcgttaccgatatgcaaatgtccggtcggactcggtgcataacgaacgcgtacttcatttcccatgttcaaatacttcctttcatctcgtctgtagcctctagccgaatatatgtatctattctaccaccaaatagacccggcatcaaaacaatgatcaggctttttgaatcagaacggttgcctgagcggcaattccttcggctcttccggtaaacccgagcttttcagtcgtcgtcgcttttacgtttacttgagagacgtccgcctcaaggccttccgctatccgttttctcatagcatcaatatgcggcgccattttcggcttttgcgcaataatcgtgcagtctatatttccgagtacgtaccctttttcttttacaatgttccagacatgctgaagcagcttaaaagaatcagcatccttgaattccggatcagtatccgggaaatgcttgccgatatctccttcacctgccgctccgagacacgcgtctgcgactgtatgcagcaatacatcagcatctgaatgtccgagcagtcccttttcataaggaatttcaattccgccgatgatgagcggacggccttccgttaattgatgcacatcaaatccttgtccgattctaaacattatgattcccactttccgctttcatgattgcttccgcaaatatcaggtcatccggcgttgtcagcttaatattggtatagctgccttcaacgatactcacctgatatccatcaagacgctcgacgaggctggcgtcatccgtacctaagaagcctttgttttccgcttccatatgcgccgtcttcaataaagaaagacgaaaagcttgcggcgtttgaacggcccacaagcttgaacgatcaaaggtctccgcagcccgggagccttccgcccgttttatcgtgtctttcacaggaacagccaggacagccgctcccgcctcctctgctgtttcaacgagcttatcgatatgctgatgtgtgacaaacgggcgcgctccgtcatgaacaagcacgaccgattccttatcaatcactttcagtccttcgtatacactgtgctgacgctccgcacctccggtaacaagctcaatttccgtctgaatcggaaattggaccagcagctggcgaaaatcttcccgttcactctcgtttatcaccaggattattttctgacagggtgcgtggctttcaaaaacccgcagtgtgtgtataataacgggcgcaccttttaagctgatgaacagcttatttttcccggccttcatccgttttccttgtccggcagccggaataacgacaacatactccatatgaactccctcttaaagagctttctcaagcagcttgggcttggcaaaaatcattcgtcccgccgctgtctgcagtacgctggttacgagcacatcaatatgtttccctatataattgcggccttcttccacaacaatcattgtgccgtcatctaagtaagccacaccttgattatgctctttcccgtccttaatcacctgcacattcatctcttcgcccggaagcacaaccggcttcaccgcgtttgcaaggtcattaatattcagtaccgcaaccttttgaagctcgcatactttatttaaattaaaatcattcgtcacaacgacaccggatgtcagcttcgcaagtttgacaagcttgctgtcaacctcctgaatgtcttcgaagtcgccttcataaatttcaaccgtaatatccagttccttttgaatgcgattcaagatatccagtccgcggcgtcctctgttacgttttaaaacatctgaagaatcagcgatatgctgtaattcctccagcacaaattgaggaatgacaatgacgccttctaaaaagcccgtctgacaaatatctgcaattctcccatcaataataacacttgtatccaagattttcagccttttatcctgttcttcctgctcctcatcagcacttccctttttcttctgcattcttgcagaaatggagaaaagactgatcagttcatcctttttcttaaatccgacttggaagcccagataaccgagaaagaaagccagaaagaccggaatgatggtgctgaatatacggtacggaatattgtccagcggaatcacgtttacaatgagatatgcgatgataagtccaaaaaccaatccgagactcccgaataacagatccggcaccggagctctcagcaaagaatcttcaatccattttacccaattaatcacatattctgtcgtccatatactgatgagaaaaaagataatagcaccaattgcagcagacgtatatgcgtttgttattaaaggtatgtcctgtatatttgacagcacaaacaattcaggtattaaaaagataccgacaacgccgcccacaataatgaagaacgcctgaactattcgttttaacatacctccacctccttttaagtagcattttttcagcagactgtcagagcctacaaattcagaataaacaaaaactaacaataatatacccggattccgacaggtttaagcgatacttaaagctgtctatctatatagtgtttttcctgaaggcgttttaagccttttttgattttttgggcgcgcacttcgccgataccctcgacatcatcaagctcttctacagtggcttccgttatgctgggcaaaaatccgaacgcctcaaccacattttcaacaatcggcatcggcagacgcggaattttgttcagcagcctgtagcctctcgggagcacataatcatcaagattcgtagaagccgggtatccaagcagtttaaacagaatggaatcatccagcagatcatagctggacatatcctggagctcttttaacagcacgaacggatctttgattttttctttgacatagtctttgatgaaaagtgccgcctcttcttccatgtccgtaatcagttcaatcacctgcagacggattaagtgtccttccgttccgagttctttaatatacatattgatttcattttttattcggagcaccatttcataccgatgcatgacagacagcacgtcactgaatgtcacaagctcctcaaactctaatgcgtttagagccgtaattgttttgtctaaaatggttttatacttctcgagcgtttgaatggcctgatttgcctttgttaaaataaaacctatgtcctttagtgtgtacttcatgctgtcctgatataacgtaatgacatttctgcgctcagaaatggcgatgacgagacagccggtctgcttcgccacccgttccgccgtacggtgcctcattcccgtttctgaagaagaaatggtcgcctccggcataagctgtgtattcgcataaagaattttctggccggaatcacttaaaataatggcaccgtccattttggccagctcgtataagtgagcgggcgcaaatgatgtattaatatgaaaaccgccatcgacgacttgctttaccttatcattgtatccgacaacaatcaggccgcctgtatttgcccgaagtacattctctatcccggctctgagcggggtgcccggtgcaacgaactgcagaattgcagacaggtcaagctcttgtttcgccccttttttctctttttccatctattatgatcctcctaatgaagtacgaagcgcttctgcaacatttgctactccgacaacctcaatcccttttggtattgtccacccatctgcattcgcctcaggtatgatcatgcgcttgaagccgagtttcgccgcttcttttacgcgctgttcgattcttgacaccctgcggacttctcctgtcagtcccacttcaccgataaagcaatctgcgggattcggcggtgtatctctgaagcttgaggcaatgctgacggctactgccaaatcaatcgccggttcatccagtttgaccccgccggcgacttttaaatatgcatcttgattttgaagcaaaagacccacccgcttctcaagcacagccataattaacgataccctgttgtggtcaatgcctgtagccatgcggcgcgggtttccaaaactggtcggtgatatgagcgcctggatttcaaccagaatcggtctcgttccttccattgacgcaacgatactcgaacccgatgccccggcagaacgctcttccaagaaaatttcagaagggttgagcacttccgtaagcccctcttcccgcatttcaaagatgcccatttcatttgttgagccgaaacggttttttacggcccgcaaaatacggaatgtatgatgccgctctccttcaaagtatagaacggtatcgaccatgtgctcaagcaatctcggccctgcgatcgatccttcttttgtgacgtgtccgacgataaaaataggtatgccgtttgttttcgcgattttcatcaattcggccgtacactctcttacttgtgatacactgccgggagctgaggtgatatcactttggtaaacggtctgaatggagtctacgacaacaaatgcgggtttcatctcttgtatagcagacgaaatatactccatatcggtttcagataaaacatgtaacatttggctgttgatgccaagtctgtcggcgcgcagcttcgtttgcttcacggattcttcccctgaaatgtaaagcacgctgccggccgtatctgctaattgtgcggatacttggagaaggagcgttgattttccgatcccgggatcgccgccgatcaatactaacgagcctttcacaacgccgccgccaagcactctgttgaattcttcgagctttgtttgaacgcggggttcttctgatgtttcaattgatgtaatgggtgatggtttctggacggtttgaacggagtgggagaaagccgcccgccgattcgccggcgctttttttatggtttcttccaccattgtattccaagccccgcagcccgggcactttcccatccattttgcggattcataaccgcatgagtggcagatgaattttgtttttgatttagccatatatgttgtaagacctcttccttatcgaatatttctctatataacaaagtgaggcatacactcgcttacgtatgcctcatgtttgtcactatattagttcgttttagcagttgtttttacgacaaattcgccgtcctcaacatcaagaacaatgtgttggcctttatcaatattgcctctgaggagttcttctgataaccggtcctccacatgcttttgaatcgctcttcttaacggacgtgcgccgtattccaaatcgacgccctcttctgctacttttgctttggcagcatccgtcagctcgatagagagatcttgttctttcagacgttttgttaactgatcagacataagcgacacgatgtctgtaagatgttttttctcaagggagtggaagacgataatttcgtcaatccggttgataaactcaggtctgaaggcacgcttcaactctcccatgactttgtctttcatgtctttatggttttgtgattcatcctggacattgaagcctacatatttgttgcgcttcagctcgctcgccccgacgtttgacgtcataatcaggatcgtgttgcggaaatccacagtgcgtccttttgaatcagtcaagcgtccgtcttcaagcacttgcaggagaatgttaaacacatcagggtgtgctttttcaatttcatcaagcaatacgacagagtaaggttttcttctcactttttctgtcagctggccgccttcatcatagccgacatatcccggaggagaaccgacaagacgtgaagtcgagtgtttctccatgtattcggacatatccactctgatcatcgcttcctcatcaccgaaaatggattccgccagcgctcttgccagctctgtcttcccaacgcctgtagggcctaagaagatgaatgaaccaatcggacgtttcgggtccttcagtccggctcttgcacgtctgacagcctttgccacggctacaacggcttcatcctggccgatgacgcgggaatgcagaatgctttccatattgagaagcttatctgtttccgtttgggcaattttagatacgggcaccccggtccagctggatacaaccatcgcgatatcctctacagaaacttcggagttctcctggccttgtttttctttccaggtttttttcgtgtcttccacctgttctctcaggcgctgctccgtatcacgaagggaagccgctttttcaaactcctggctctgaacggcagcgtctttttccttgcgaacttcatcgagtttctgctcaagctcttttaagttcggaggcgttgtgaaagaacggagacgcacttttgaaccggcttcatcaattaaatcgatcgctttatccggaaggaagcggtcagaaatataacggtcggacaatttaaccgcggcttcgatcgcttcatcggtaatggatacgcggtgatgcgcttcatagcggtcacggagcccttttaaaatttgaatgctttcatcggctgacggctgatccacctgaatcggctggaaacggcgctcgagagccgcgtctttttcgatatatttacggtattcatcaagcgttgtggcaccgatgcattgaagctctccgcgggccagtgaaggttttaaaatattcgatgcgtcaatcgcaccttctgctccccccgctccgatcagtgtatgcagttcgtcaatgaataaaataatattgccggcctgacgtatttcatccattacttttttcaagcggtcttcaaattctccgcggtatttcgtaccggctacaaccgtacccatgtctaacgtcattacgcgtttatcacgtaaaatttccggcacttcattattgatgatctgctgtgcgaggccttcagcaatcgcagttttacctacacccggttctccgataagaacgggattatttttcgttctgcggcttaatacctcaataacacgctgaatttctttgcttcgcccgataaccggatcaagactgtcttccttcgcaatcgcagttaaatcacgcgccagactgtcaagcgtcggcgtgtttgcattgctgttggtaccggatgcagaagaccccgtctcattgcttcccagaagctgcagcacttgctgtctcgctttatttaagctgacaccgagattattcagaactctcgccgccacgccttctccttcacggatcaatccgagaagtatgtgttctgttcccacataagaatgtcctagctttctggcttcatccatgctgagctcaatgactttttttgctcttggcgtataatgaatcgtttgagacatttcctgtccccgtccgattaagctctccacttctttctgaattttatccgaaccgagtccgagtgcttggagtgctttagccgcaatcccttctccttcacgaaccagacctaataagatatgttcagttccaatattgttatggcctaagcgcagtgcttcctcctgtgccagtgccaataccttttgagctcgctctgtaaaccttccaaacatcatatcgaatcatcctcctgtctatttgcactcatttctaaatgcagcctttccctgataagcgccgctcttctcgcgtctctttcgttcggccgtaatgcaccgcccgaatattgctggagaaaacccggctgtgtcaaaatcatcagttcattaagtatattgcttgatagccctttgatgatcccaaggtctatccccagccgaacgtcagaaaggcatttcgccgtttcctttgattcaatcatacggcagttggataaaacgccgtaagatctgaatacccggtcctccaattcaattttcgaagtttggtaaagcgcttctcgggctgaacgttcctgctcaatcagctgggcagccacactgtttaaatcatctacaatgtcctgttctgattttccgagtgtgatttgatttgaaatttgaaagatatttcctaatgcttcgctgccttcaccgtaaattcctctaacaactaagcctaattggttaattgccggtataattcgattcatttgcctagttaatacaagacccggcaaatgcatcatgactgaagcccttagtcccgtccctacatttgtaggacagcttgttaagtaccctctcttctctccaaaggcgtaatccactttctcctcaatccagtcatcaacctggtttgccgcttttatggcgttgagaagctggaagccggggaagaggcattgaattctgatatgatcttcttcatttaacataatgctgacttcttcattttcagaaagcagacagccgccaaaaggagattccgttaaattcgggctgatcagatgtttctccatcagcacccgtttttccaaaggctgagcttcactcattctgattaaatgaaattgaccgatatcaggcagttccttacctgaaaaatgatcttcgaattgctgaatgatggatgaggcttcttcattcgtataccgggcgggaaactttatattttcaaagtttcgggccaaccgtatacggctgctgagtacaatgtcactttcaggtcccttttgcttcatccaattgcttagtgcgtcctgaataaaatgcttgagcgacattacccttgttccccctcactgtctgtactttttaattcctgctctaacgatcggatctgatccctgacctccgctgctctttcaaactcttcgtggtgtattaaagattcaagttctttttttaacatttccatttgccgtcttacatgcaggtttccgcctattcgttttggaattttcccggcatgcaccgtattcccgctgtgaacttttcgcaagatcggcgtaatttggctgtagaacgtatcgtaacattccgcacagccgaaacgccctgtttttctcagctgctgaaacgtcataccgcatttcttacaagctgtgccttgctctgagtagccgaacatttgagaaccggtgttttgaaatgaggactccatattcagcagtcctgataataaattatgaattgagaacccttggtttccacttatactgtatgaatcgctattttcttttgcacattgttcacaaatatgaacttcttgcttttctccattaacaactttcgtaaagtgaaaagtggccggtctctcattgcattcttgacaaatcaatcttttcacccgcttactttagttttaaagatgtgagcattgctttcatcattctggctcttagttcatcccgttcgggcaaatcaatatatagaactgaacgatccattacactcaccatcattttagcttctctttccgaaataactccgtcctctaacagtctgagaataatgtcatcagaggctgcctgggacaagtgggtatggatctgcgaaataatattattgatgaggacgacttcgttattcattttaattttgataatacgaatataaccgccgcctccccgtttactttcaacaatatatcctctttcacttgtaaatctggtgttgatgacataatttatttgggaaggaacacattgaaatttatcagcgatttcactgcgtttgatctctaaaatttctttgccattttgatctaatacttgtttcaagtactgttcaatgatgtcagaaatattatgtcccactcaaccccctcctttattgactttgactatatttgactttaatcttactataaggtgtttcgcaaaatttttcaactgtatcgctctatctctattatttccactttacacaagcataaaacctgcttttgcaaaaagccatatcgttacttttctcatactatataacgtatgcagaaaaacacaaaaaaggcagctcatgatgagctgcctttaccgtaaatatagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccatctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattacaattgaatgtgaattacttctgttatctagttttcaaagaacaacatctcgaagaatcgaatgatccttcaaaactaaacaagacagggaacgtactgtttataagacccgaggtctaatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattttgttcactttctcaagcaactttttaagtatataataagtttctcttaaagtcaacatgtttttttataaatggtggagcctagcgggatcgaaccgctgacctcctgcgtgcaaagcaggcgctctcccagctgagctaaggccccgaagtggtcgggaagacaggattcgaacctgcgaccccatggtcccaaaccatgtgctctaccaagctgagctacttcccgatttttaaaaatattatggcgcgcccgagaggagtcgaacccctaaccttttgatccgtagtcaaacgctctatccaattgagctacgggcgcataataatgaatgccgagggccggacttgaaccggcacggtagtcacctaccgcaggattttaagtcctgtgtgtctgccaattccaccaccccggcgtggatggtatagttggagcggaagacgggattcgaacccgcgacccccaccttggcaaggtggtgttctaccactgaactacttccgcatacaggataactatcctgtataatgcgggtgaagggacttgaacccccacgtcataagacactagatcctaagtctagcgcgtctgccaattccgccacacccgcgttacatggtgagccatgaaggactcgaaccttcgaccctctgattaaaagtcagatgctctaccaactgagctaatggctctttttaaaagacttgtgttattatcttgtccaaaaatggtgccggccagaggacttgaacccccaacctactgattacaagtcagttgctctaccaattgagctaggccggcaaatatggtggaggatgacgggctcgaaccgccgaccctctgcttgtaaggcagatgctctcccagctgagctaatcctccatatattacacttacgtgtaatggcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacggccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcaggaaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaatatctcgaagaatcgaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgtcacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattttgtctttcgttcaagcgactttattattatatcttatcaatctcttgaagtcaacaactttttaaatttctttttttcgtcagcgccttgtttagcggcaacgaataataatataccacctcacaaataatagtgcaatagtttttttaaagaaaatcaaaaagttttacgagcggcttgtttctaaaaaagcgccgtactgcgataagcagaaaacggcgccttcccttttattagcgttgtctcatttgagggaataataaaacgtctctgatagacggagcatttgttaacagcatgacaaggcggtcgataccgatacccaatcccccggtcggcggcatgccgtattcaagagcttcaacgaagtcttcatccatcatatgcgcttcatcgtttccttcttctctttcttttaattgcgcttcaaagcgttccctctggtcaatagggtcattcagctccgtaaacgcattagcgtgctcacggccgacgataaacagctcaaaacggtctgtaaagcgagggtcctccggatttttcttagcaagaggagaaatctctacagggtggccgtaaataaatgtaggctgaatgagtgtttcttcaattttttgttcgaagaattcattgatgatatgacccaccgtcatagagtttgtgatctcgataccatgctcttttgcatgaccgcgcgcttcttcaacagtcatctcattccagaaatctacgcctgtcgcttctttgaccgcatctaccatgtggagtcgtttccactcaggtttcagatcaatctgctcttcgccgtactggattgtggtgcttccaagcacttcctgcgcaatatgtgctacgaggttttccgtaagactcataatatctttataatcggcgtacgcttcatacagctcgatcatcgtgaattcagggttatggcgtgtagaaacaccttcgttacggaacacgcggccgatttcgtagactttttccaatccgccgacaatcaggcgtttcaggtgcagttcaatcgcaatacgcatataaagaggcatgtcgagcgcgttatggtgcgtgatgaacgggcgtgcagacgctcctcccggtatgctgtgcatcgtaggtgtttcaacttctaagtatccatggtcatctaagtatcttctcatcgcttggatgattttgctgcgtgtgataaacgtttgtttgctgtcagggtttacgatgagatcgagatagcgctggcggtaacgctgttcaacgtcttttaacccatgatatttatcaggaagaggacgcagtgcttttgtcagcagttcaaaagatgtcgctttgacagaaagctcgcctacgtttgttttgaaaactttcccggtgatgccgataacgtctccgaggtctgaagatttaaagatttcatattgttcttcgccgacactgtcttttcttacgtaaatttgaatttgaccttctaagtcctgcagatgcgcaaagccggctttcccttttccgcgctttgtcatcatacggcctgcaatggtcacttcgatcgctttttcttccagttcttctttagaaagctcctggtaggcgtcaatgatttgttgagattgatgcgttctctcgaaacgttcgccgaaagggtcaatgccgttttctctcagctggttcattttatctcgtctgacttgcagctggtcgttcaattcctcatgattttgctcttcttgactcattggtatcactccgttacattttgatttcacgaaaaagcagaaaaactgccagcggtaagctggcagtgagcagcaatagagggtgtatattaacctacttttgcatcttgaagctcttttgcctctgcttcggcggtaaatgcatctaaaagctgcacaaatttttcacgcgtctcacattggttaatttcattgcgtacattcgcattgcctctgacacctttcagataccaggcagcgtgttttctcatttctctgactgccacattttcgccttttaacttaatcaggcggtctaagtgcagtttgcataccgacattttttcacggactttcggctcgtcttttaactcaccggtttcaaggtactgcaccgtacggtaaatcatccacgggttgccgagtgcggcccggccgatcatgacgccgtcaactcctgtttcctcaagcatgcgtttcgcgtcctgaggcgttttgacatcaccgtttccgatgacgggaatggagacggattgcttcacttctttaatgatatcccagttcgcagtgccttcatacatttgcactcttgtgcggccgtgaagggcaacggcttttccgccggcacgttcaacggcttgggcgtttttcaccgcataaatgtgatcttcatcccaacccattctcatcttcactgtaaccggcttatcaacagcatctactactgcggataccatttcataaatcttatcaggatcgagaagccatttggcgcccgcatcacattttgtaatctttggtacgggacatcccatgttaatatcaataatatcagcagtcgtgttttgatctacaaacttcgccgcttccacaagggtttccttttttcctccaaaaatctgaaggctgagcggtttttcacgttcatcaatgtaaagcatccccattgttcttgcgttgttgtaaaggatcgctttgtcactgaccatttcagcgcataccaatccggctccgaattcctttacagtcaatctgaacgctgagttgcagacaccggccataggggcaagcacaacccggtttttcaattgaatatcaccgattttaaacatttttcccctcctttcatttgtctatttttcaggcggggccaattcgtccgcacttatatttaaaacatctgccgcatcttgaatgatggcatctgacggcaatcggtttccgcgttcaatttcaccgacaatagaaactgatatacctaatgcttttgcaaatccttcttgagtataacctttcagctttctgaatgcacgaattcgcctaccccagatttctgcttccatactcttacaccttcttggtttgtttcagcgcttatcgtgatatgatccgcctgcggacatatttcttttaacggcgcaaggacaaataagcgctcatacattctcggatgcggaacaatcagccgctctgtttcaatattttcacgattatacagcaaaatgtcaaggtctgccgtccgcggtccccagcgaatctctctcgttctgcctaattcagcttcaatggactgtgttacatctagaagttcaaaaggagataacgacgttttcacttcaaccgccatattgagaaactgatcctgatcctcataaccgacgggatctgtttcatatatagaggatatctttgacaccgtcacgccatcatgccgggtgagcatggccactgcctggcgcaaataatgttcacggtcgcccatattggaaccgaggccgatatatgccgtattgttcatgatttctttctcgtcatttctatggctactgatttataatggccgggaatcggcgggtcaggcttaacaacctttaccgtacattgctgcaccggctcaaatttctcaaggacggtgtctgcgatccgttccgcaagggtctcgaccaaattaacgggctcgccctcaacgatgccgcggcagacactgtacaattccgcatagttaatggtataagaaaggtcatccgtttttcccgctttgctcaaatccagttcggcagtcaggtctactttgaagcgctggccgagtttgttttcttcctcgaacacgccgtgatatccgtaaaactccataccttccacatatactttatccataatgcgcgcctcctttgttcagcatagcatccatcatcttagtcattcttgcgatctctttaacatcgtgcaccctcacaatgtcgcagcctttttggacgccaaggcatactgtcgctcccgttccctcggcacgttcttcagggggaaggtcaagcacacggccgatgaacctttttctcgatgtcgccaggagcagcggataccctaacccgctgaacacctccagcttgttcatgacagccagattgtcctcatagtttttcgcaaagccgatccccggatccagaatcatgttttcatctgtgacgccggcttctgcggcaatttttacgctttccatcaagtctgcaagcatatcaggaataagatcgttatagtttctttccatacgattatgcattaagataatcggaactccgtgtgcggcggctactgacgccatgtcagggtcacctttcgccccccagatgtcattaaggatagaggctcccgctttgaccgcttcgtctgccacggacgctttgtacgtatcgattgaaagcggaatgtccagctcgcttgtaatccgttctatgacggggatgactcgtgacatttcctcatcagccgaaacgagtgatgcgccgggccttgtcgattcgccgccgatatctatgatatgcgccccttcttcagccatcttcgccgcatgcagaagcgccctttccgtactgtcgtatttgccgccgtcagagaaggagtctggcgttacatttaatatccccataacgagcgtcttctctttataggacagagcgcctttttttgtatgaatcagtttaggctgttcaattgtttgctgcgccattttgttcctcctcctgtacattcattttgtttatttcctgccgatactgcttacggagcaattgcaccgttttcccgctcattccgggcagcggcacttcctctattttagaaaacgggatgatttcaagcacggagtttgtcaaccatgcttcatccgcttcaagcattgattgaaaacggaatcggccttcggtgacttctgtcccctgccgtttcaattcatcaatgacaaactgtcttgttacaccgtcgagaattcccgtatccaaagatggcgtaaagaccttgtctccttttcgccaaaacacgttggagacaatgccttccgcgacatctccttctccggtcaggaaaatcccttcaagattgggatcattcccgatctcccgtttagcgtacatgttgtttaaatagtgatgggattttaaccggaaagatccttcaggcgtatttctccggacagagagaagcctgccttctttttgaacaggcagagtttccggattgagccggttcacgaaacaaaggacggtcggcttttcataagtctgcgcggcaaatcccttatcgctgacgcctgccgagatgttaagccggacacgcgcgctgccgtcctttatgtcattgagaagcaacagtctccgaagcatatcaagcagctcctgtttgttcacctcgaatgcaatctgcagatcccgaagcgccctgttgagcctggcgacatgcgcatccggcagaaacggccggccgctgtaaagcctgaacgtctcgaacgctccgatcccgtacagataaccatggtcaaaaggagaaagcgccgcttctttctcctctatatattgaccattcaaatatataatcacaccgatacttcctttttgcggtgtgtctctataaagtttctgagcatctctttgccgaaggaggtcatgatggattccggatggaactgaacaccttcaacaggcagctcattatggcggatggccataatttctccttctttggtttgagcggataccgtaaaacaatccggcagcgtgtccgctttgacaataagtgaatggtaccgggtggcgaccagcggattttgcaggccgttaaaaatcgtctgtccgtcatgcataacttctgacgttttgccgtgcatgagccgctctgctctgacgacatcgccgccgaatacttgcgcaatcgactgatgcccgagacatacgccgaaaataggaatactgccggcaaaatgtttgatggcttcgaggctgatccccgcttcatcaggactgcacggcccgggagaaatcattaagaagtccggacccagctcttcaatctgctcaatcgtaatctcgtcattccgtctgacgatcagttcctccccgagctcacccaaatattgaaccaagttgtacgtaaatgaatcataattgtcaatcattaaaatcatctctgctcacctcgtctgattttttgtctcttcttcgctcagctctaacgcctttttcatcgcaaaagcttttttgaacgattccttgtattcatgcttcggaaccgaatcaataaccactcctgctccggactgcataaaagcatgtccgccggctgcatagatcgtccggatcacaatgttaaactgcaaatctccgttgaatccgaaccagcctatagatccagtataaagcccccgtcttgtcggctcaagctcttctataatttccatcgttctcactttgggcgctcccgtgatggtgccccccgggaacaccgcatgaataatgtctgtcgcgtcatatccgtcctgcagctctccctgtacgtttgacacgatatgcatgacgtgggaatatttttcgatcgccataaactcgttaacccgcacggagccgtagcgcgatacgcgcccgaggtcattacgctcaagatcaacaagcatgacgtgttccgcacgttctttttcgttgtgaattaattcatcagccaaagccttgtcttcagcatcgtcttttcctcttgaacgcgtacccgcgatcggtctcgtttcaagcttcttccccttctttgtcaccaatagctccggcgacccgcatatcacttgaaaccccggtgtctcgagataggccatgtaaggagacggattgacgtttcgcaagtgtttatacacctcatacggatgaacggataaagactgagactgcctgatggacaaattaacctggaacacatccccgctcgcgatatattgtttaatttgttctacagcctgtgaaaatccttcctcggtgaacggagcggcgtacgatccgtccccattccgattcagcggtgaaaaaggctcgtccgccgtttggagggaacaccacatgtcctctaagccggacagcttttcttccgcaagatccgcttcttccgcttcagtatgggtaatgagccataacgcctcttcctcatggtcataaacggccacatcatcaaaaacaagaaagtaaatatcaggtgtttccagatcatctaacgacagcatcttaaaattctcaatatatcgggcatagtcgtaactgataaaaccaatcgcaccgccctgaaagtccggaaactcaacgtttgtttccgttccgagcgttccaaaccattcatgaaaggcccgcagcgggtcaccttctttaaacagtgtttctccctcatgcttgatcgttgtaattccgtctttccctctgacggacgcaatcggatctagaccggctatactgaatcttccccctctcgcgctttcgagcagaacatgccgttttctcgatttcgaaaggttttcatatcgctgtaaaaatgcttgtttcgtaaaaggtatttttcttcctgccggtctgcgttgtgccatcatatcaatcctctgcttcgttttactgtagttttattttaaagcaatcacactggtgaaaaaagtgaatttcacttccaaccataaaattcgaaacgttttttggattttcgatacttcaggcacaaaaaaactcccggatacagccgggagccgtgtgtatgtctctattcaaactgataaagcggtgtgcttaagtaacgttctccgttactagggatgatcgcaagcactttcttgcctttcccgagttttttcgcgatttccagtgccgcgtaaatggccgctccggaagaaataccgccgagaatcccttcttcttttgccgttttacgggcatattcaaatgcatcctcgtttttgacgggaatgatttgatcatagatgtccgtattcaatgtttcagggacaaatcccgctccgataccctgaattttatgcggacccggttttccgccggaaagaactggagaatccgccggctctaccgcatagattttgatggatggatatgcttttttcagcacttcgcccgctcccgtgatggttccgccggtaccgattccggccacgaacgcatcaagctggtcgtcaccaaactgttctacgatttctttccccgtcgtttggcggtgaatttccgggtttgccgcattgttgaattgctgaggcacaaagtatccgtgttcctccgcaagttcttccgcctttttaatggcgcccttcattccttctgcgccgggagtcagcacaagctccgctccgtatgcgcgcagcagattgcgtcgttccatactcattgtatcaggcataacgagaatggctctgagacctttagccgctgccaccatcgcaagaccgattcctgtatttccgcttgtcggttcaatgattgtgtcgccggcttttaattttccttctttttcagccgcttcaatcatcgccgctccgatacggtcttttacgctgctgcccggattcatgtattcaagcttcagatatacatctgcactgttttcatccgtcaggcgattcaatttcacaataggagtatttccgattagttcagtaatagaatttgcaatacgcaccatgttggacacctcaatttccgactaaatttattggtattataaatataagttatcaatttcaaaattttttgtcaatcatttagttcttttttccccgtagaaccaagagacccccgcctctttccacagcgttttgactgtcgccttgtcacctaattgatccatcgcgatctggcgtctgatttgactcttcacttcattgtatgagaaagttctcgctttaagcttttctttcagctgaatgacggcatatcctgaagaaactttaatcggttcagcggaccattcatcttctttgagatttttagcttctgtgatatatgcctgcgggatattttcctggttttctgtcacaaagccgaggtctccgccatactgagacgtgtatctgtccgtggaacgctcagcggcgacggcttcaaagctggaaccgcctttcaaatcagcaagcaccctgtccgcctcttccttgtttttgacgacaatgtgcctgattctgtaggaatcatcgaaatggtacagttctttatttttattataaaatgattgcatttccttatccgatatatcgatgtccttcgtcagcagttcttcaagaagaatgttgtagcggatctggtctctccattctttttcggtaatatggctgtcttcataaaatgaattattcaccgctttgattaaaagaaattcacgttccaattcggtgtttgaaactgtgagtttattctttttcgcaagttcttccactacttgtgcattaatcatatcctccagagttgattttccgtactcgtcttccatctttttcatccagtcctgccgtgtgatatgtttatcaccgattgtcgcgatggattcttcagatgaccccgcggcttgggattttgttaacttatacgccactgctacactgcataccaacagcgccgctacaataatcgtcaaaagtgttctcgatttcaaaatctaccccatcccttttacaaaatagaacaacccgctaaagagctagcgggttgtttcgtcacgaagctcttccagttcttcttttgtaaataaatatttctcattacaaaaatggcaaaccgcttcggcttttccgtcttcttctatcatatcttgtatttcttttttgcctagtcctaaaatggccgtttcgaatcgatcttttgaacaagaacagtgaaatttgaccggcattgtttcgagaacgtccggtttttgacccagaacttcttctaagatttcttccggtgtcaggcctttttgaatcaattttgaaatcggttcgatttgagataattgcttttcaattgttgaaatggtttcttcatcagtccccggaagaagctgaatgatgaacccgcccgcagcgagaatcgtgttatcaggatttactagtacacctaccccgacagatgaagggacttgttcagaagaaacaaggtaatacgtgaagtcatcaccgagttcacccgagacaatctctacttgccccgtaaaataatcacgcaagcccaaatcttttacgacactgagtgttccgtcagttccgaccgcccgtctgacatccagtttcccttgttcattgaggtcaaaatgaacgtgcgggtttgatacgtatgctcttacctcaccctttgcgttcgcatctgcgacaatggctccgatcgggccgccgccttctattttgactgtcagcttatcttcacccttaagcatcgctccgagcatcagagacgctgtcatcgtccggccgattgcggctgatgccgtcggccacgtgtcatgccttctttgcgcttcatttaccatatctgtcgttctggctgcataagcccgcactttaccgtcatatgcaattgctttaattaaataatccatcgtttacctcctatatgtgacccacgcgatttcgctcataaatgatttccagcccttttaaagtaagaaacgggtcaacaatatcaatacagtctgattcgtttgcgattaatgacgcaagcccccctgtcgcaatgactttcggttcttgtttggcctgccatttcatccgctttacaatgccttcaacttgtccgacatagccgaaaaggatgccggactgcatggcgcttaccgtgtttttgccgatgatattatccggtcgggcgatttcaattctcggaagcttggccgcgcgtgagtacagcgcttccgttgaaattgtaatgccgggagcaatcgcaccgcccatgtattgtttgttttcatcaatgtagcaatacgtcgtcgccgttccgaaatcaacaacaattaaggggccgccatactgctggatcgctgcaacggcattgacgatcctgtcagctcccacttctttcggattgtcatattttatatttaaacctgttttcattcccgggccgacaacctgcggctcgatgtgaaagtattttgtgcacattctttctaaagagaacataatcggcggcactacggatgagatgataatcccttcaatctgttcaaacatcagtccggaatgttcaaataaggagcggagcagcatgccgaattcgtcttctgttttgtgcctgctcgtttctatgcgccaatgatattctaattccccatcatgatatacaccaatcacggtgttggtgttccccacatctataaccagtaacaacctctatcaccacttttgaatagtttctaatcataacattttcaacattctacaataccatacacgatctgcggctcttttgtaaacaaaacggaaccagtaaaaaaaccgccggtatacgccggcggttttcatatcagaaagcgaactattctttcggctcgtctttcttttcgtcttctgttttagacaggatgtttactttcacatcgtctttttgaagatggtcatctgagaaattgcgctcagggagttttccgtgatccacgagatgcttgatttgttccgcatctaatgtttccacatcaagcaatgtctgagcaatcaattcaagcttatcgcgattttcagtcaggatggttttcgcacgctcataacattctttaatgatgcgctgaatttcctgatcaatttcgtaagcgatctgatcactgtagttttgctcgttgttgaaatcccggcccaggaatacttgaccgccttgagattgaccgaactgaagcggtccgagtttttctgacataccgaactctgtcaccattcttctggcaatgttcgttgcccgctggaagtcattgtgagcccccgtgctgacttcgccgaagataatttcctcggcaacacgtccgcccagaagaccgacaattttatcgagaagttcaggttttgtctggaagtaacggtcttctctcggaagcatgactgcgtatccgcctgcctgccccctcggaacaatcgttactttatgaaccatatcggcttcatccagcacaagtccgataacggtgtgaccgccctcgtggtacgccacgatattgcgttcttttttcgagatgacgcggctcttcttcgcaggacccgcaatgacacggtccgttgcttcatcaatgtcgcgcatatcaattttcttcttgttttgacgggcagcaacgagtgccgcttcgttaagaaggttttctaaatctgcgcctgagaaaccgggtgttcttgaagcgattgcttttaagttcaccgtctcatcaagcggtttgtttctcgcatgcacctgcaatacggcttcacggccgatgacatccggacggtctaccgtaatctgacggtcaaaacgtcccggacggagcaatgcagggtcaagaatgtccgcacggtttgtcgcagcgataataatgattccttcattcgcactgaaaccgtccatctcaacaagcagctggttcagcgtctgttcgcgttcatcatgcccgccgccaagaccggcgccgcgctgacgtcctaccgcgtcgatctcatcaatgaagatcaggcaaggcgcattctttttcgcattttcgaataaatcacgcacacgggaagcaccgacaccgacaaacatttcaacgaagtcagatccgctgatgctgaagaaaggaacgccagcttcaccggctgaggctctcgcaagcaatgtcttaccggttcccggaggtccgacaagcagcacgcctttagggatcctggcgccaagctcggcgaatttgcggggatctttcagaaactcaacaacctcaacgagctcctgcttctcctcatccgcgccggctacatctttaaacttcacgcgtttcttttcttccgtatacagcttcgctttgctctttccgaagttcatgacacggctgccgccgccctgagcctgattgagcaggaagaaaaacagaataaagatgatgacaaacggaatgatcgtcgttaagaacgtcacccacccgcttgtttcctgtgcgggatcaacttttacgtccgtctttttaattgcgtcaaatatctggtctgctccttttccttcaggaacatgtgttaaaaagtactggtctttgtcgtattttttcagctgtccttttacctcataaacacctctgacaggctgaaccgatacgctatcaactttcccttcatcgaggttcttgataaacgtactgtacgacatattttctgttttcgggtttgaggtctggaagtaactcacaaccccgattactactaataaaataagtaaataaaaaatggtattacggaagacccgattcattccttacctcctcccacagtaagcacaactatgttcaatagtaccatagaaaatcattccaatacaaccgataaccatctcggaagcaggcagccgatcagctttcataaatcgccggttttaatactccgatgtaaggcagattgcgatagcgctcggcataatcaagtccgtaacccacaacaaacgcgtcaggaacttcaaagcctacgaagtctgctttaatgtccgcttttcttccgcttggtttatccaacagggtaacaatcttaattgatttcgctttacgatatcggaagagttctacgagatagctcaaggttaacccactgtcgataatatcttcaatgattaagatgtcccggccttctacagatgtatccaaatctttgatgattttgacttctccggaagaaaccgtggaatttccgtagcttgatacatccatgaagtccatttccaaatatgtatcaatatgctttataagatcagccataaaaggaagcgctccctttaacacaccgattgccaacggaaacgtgtcgctgtactcgcttgttaattgttctccaagctgttttactttctgctggatctcatcttctgagatcagcactttttcgatatcctgtttcatgttaatgcttgccccctacacttttcatgctgtctatattgtaatacaatgcggtcactgtttgaaatcacaagatcgtcaaagatggattttttcaagccaggcagccagataatttcaccgctcgcatccgttacaatcggccattcgtcccgatcccgcagaggcagtttatgatcaataaatatatcttttacctttttcgagccattcatccctttaagtttaatccggtcgccgatttttctcgtccggattgttaaaggaaattgcaccttatttctgcttgtcataaaaacagcattcccatttttgatatgagggtcagcctgatcggccacctctatcataaagccgttggggagaacagcagtctcgccttccgctccttgcagctgcagctcaaagggaaccttttcacattgccattgttcaaatgtaaacaaacatgtctgatatgatttgaccaccttcagccctttcggaaaatcaagcactcccgaggcgcttccattttccgcccattccagaaactgctgtatgtggcgggcggaaaacgacgatggaacgttttcataaagatagtttaatattagttgaactcctcttctttgtaaaggtatcggaagggcaagcaattgagaggaatcgacttcaaccgatgtgtcagacttgcttgtaataaccttattcattcgttctttcgttaatgactgcaagtattgttcgtcttctgtcagtgcttcactcaccttttgaaacattttatgaacgtcaggtgattcttgttttaaaaaaggaagcacggtctttctgaatctgtttcttgtataatcgtcttttgcattgctctcatccgttctgtagctgagcccttcttgacggcagtattctaggatttcatccttttccgcatagaggaaaggcctgatcagccagccggatgcaaattcgcggacgggctgcattcccgcgagccctgcgccgagcgtacctttcgcaagcctcatgagcattgtctcaacctggtcatcgccgtgatgagccagcgccaaaaacttcgcttggtgttttgtcatcagatcttcgaaaaactgatatctgcaatcacgcgcggcagcctgcttgttcagcttattcttctttgcgtatgcagaaacatcaatctgtaccgtttcgcagaggatgtgttccgcttcgcaatatgactgcacaaacttcatatcttcttcagattcaggacccctgaactgatggtcgacatgcgccgctatgataacggaagaatgcccgaagtgcttattcagcatactgagaagcgccattgaatcagggcctccggagaccccggcaataatcgtttctccctccgcctgaagatgatatgttttgaaaaaatcttccacgcttttcacaatgtccccctcacaatgagcaggtttttttaaagatatacatatcctatcactttcattccctccaagcaaagaagaagcatgagcgcaggcgtccggccggcattagatgagaaaaaagacgatgtaagcgaaataaagggcgagaacgctgattaaaataagcgttgtttcaaacaaaccattgtgctttgcgggtttttgtttaggtttataccgcgtttgagatacagtgccctgccgcggttttgattgcggcggcttaggcttggcggcggctttccttttactcccggcgctctgccccgccgtcaggatgtcatgcttcatggcttccgcagacggatattggccgtttaaagcagaaaacagaaccttcttatacttattcagaaacgggtggccttcaatgatagaacgaagctgttctttcggctgtcctgactttttgcactctttcttctggacacagtggatcatgatcattgcgacagcaaacaggtcataggatggttctgcttttcttgttccatacccccaatagcccctgtcgtaaaactccgtatactctttaatcgcgcggccttgttttgtcgttccccctacatcaatgcagcggatggcagccggcggtccggttacaataagattttccggtttgaggtcgccaaaaacccatccctgctgatgaaggactgacaagctggaaagaagctgcaccatcagcaccggaatccactccgctcccttactgctgatatattgcggaagaagcggcccttctatgtactccatcacgtaaaaagagacatttttattcagctgcggaataaacgcatcgtccgcatcaaaaaaagaaggccccatcgtttgcgaccgggcctttgaaaaggattttaagacattcacttcagaggtaacagacatgctgtcgctgcttattttcaaagcgacctgtccgcctgatgcttctgccagatatacaataccgttagccccttttccaagctgtttgagcaatctgtaggatttgccgttccatttgccctgaattgccgtccccggtgccagactacatgccaaactcgttaaagcgtcgttcatcatctgccaacatgctccttcttgagcggattctctcaaactgctgcgtcgcttcccggatagcggggcccgtaggggtgataccgccggtcgacagcttcgcaaagagcgcagaaagggattcaagcttcggcgtccaattcagcacaagctcaacttcctggcttttcccgggaaatatacacatggcaaattcattttgtccggcccgggaatttaaactgatggaaagatcaatcagcgcttctttcaccgtcggcagtttcggcgccatactcgcactcgtatcaaccagcacaagcacctgcagatgaactgtttctccgagttcatcaaccacttccatcacttcgccgcgtttttccggagaaagctcttccatttcaacgtttttccctaagatttgtttaagctcttgattgacgacaccttgcagcgtctgggtcattgcttttttcgtcaccatttgaaccgtctgagacaattgtgacgcatatacaacttgatggacgccgccaccggccatggcgatgccttcaacttccttcattgcctcttggtcaatcgcgttttcttccataatccctataacattcaccgtaatcccctgctccttggcgaaagccgccattgcaatcgggtcttcaccatgattggagcagccatctgtaatcagcagaacttgatttaaatgtcccttattcacatacattcctcccggtgatacgattagtcccatcttcgccagaaggaaagtgatttatacgaaaggattaagaaatctcctttttattttggaataccgccggcaccggtatggaagcccatttcggcgtgttgtgatcaatccggacaacaaccaccgtcatatcgtcttcgatttggccggaacgcgttctgatgacctcttccattaatatatcagcgatttcctgcggatcttcggttttcagccctttcattttccgtttcatccacaggtcgtggttttcaacgtgcttcggtccttcaaaaataccgtcactcatcatgacgagcagatctcccgcttttaactgttcacttacaacctccacatcaaattcattgatgataccgatcggcagattgctggcctgcactttcatgacttgatctccccgcttgataaaactcggcgttgaaccgacctttaagaatttgcagcttgcatcctgaagatcaatgatagaaagatcgagagttgagtagatttcgtctgtcgtccgtaaagacagaatactgttgatcgttttgatcgctattttttcatcaatacctgattcgagaattttttcgagcagcttaatcgtttcgttgctctcataatgagccctcgccccattgcccatgccgtcactgattgcggccgcatattttctcgcccccagttccatcatgctgtagctgtcgccggagacaaggccgccgccttttgccgcatgagccgcgcctgtcgatacccggtacgatttggtcgaaccgaacgcaacatggctgtagccattcggatgagccgagtgctgttcgcttttgacaagtatctgctcctcaagaatgtcagacagcatcggggcgataattttctcactctcgccgtgtcctccgctgaacgggattgtcatttcgatatcaatattgccctgctccaagctgtatatctcgacatgctgaatctcgattccgaaatgctgaagcgcctctatcatttgttcttcctgaataaaatgctgctccctctcccgttttatttcccgagaaaagtccgccataacctcagaaacccccaacagctgctcggcaacaagcctcctgctgtcctgaacttttctcttcagtgtcagatgggcgtgatggtgggcaagttcgtcctcaatcagctcttccacctgtctggatttggaacagtgctgttgaaactcttttttcaatctgcggtttgaggcatactgcttttcttctgtttcatgcataacttgtttcattaagtcatatgttttatcaaagttttgaacccagcatttgctttttttatagcaggattggcaggaatgctcggtgattttgcttaaaaagagatccacttccccttcttccgcctgctcatcggaagacgtctgatgaaaggtggcgaagctctccgacaaggcatgaaacacattggagaactggtctactttctgggcggtgacatctctgattttcctcgcgtactgctgctgctcctgactgtgctcagcagtgcccggtatgtatcgcgccacctttttcgtaatcgattggggcgtaatcaaaaacaatacaacggcaatcaaagattcataaagagtggtcattaatccggcagacccttcaccatataatgaaatcagcagtgagccgatcaccaatccgactgcggcgccggctttctttccttctttcagcagcccgccaagaagcccggaaaacgcaagcagactcatttgatagagattcccgatattcgcaagcccgaggatcagtccggtcacaacaccgaccgtacagccgatgcttgccccgccgacaaaggaaaaactcagcacgacatagcgggccaggatatgttcagcctgcattccctgaaatgaaacaccggcaagcccggttaaaacggatgcgatcaagatcataaaacagatgatttcttctatttttaacgattgcttcacttttttgatcgtgaaaatcggcaggctttgtaaaaagatcagcgtcaaaataaaggccaggcccgcctcgacaacagccatcacataatcataggtggtaaaagcgccgctttcaaaataaacaaatccgattctcgcggcagccatagagaaaaacaccacgatcggcagcatcttcacccggtcctgcacgatatatgtaccgatttttgaaaatagagtgaagacggccaaagctgtgagaatcaataaagagtgtttcggcgaaatggttaaagcgcccgcaagtaaagacagacaagcatagaaggctttatctcttctgatcaaaagcatcgctccgaaaaacggcagtgcaaatggaagaacctcagataatatgaaagcccgtccaagtaaaaaaccgatcacgacataaatgaaacccttatagaaaaaaagtgaatgcgcttgatggactgtaagctttgccgccttttcaaaaaacgattgcagtttttccagagcttgtcccgccatcggcccgttcactcttctttccgctttttccattgctctcatcccccacctgttttattcgttgcttgtcattataaatgaaagcccagataggattttgtcaaaagaaggtaacaattccaaagaactcttcgacgctttctcccttgttcccctttccttttgtatttcctccgacatttctcaaaaagttgtctaaatatgaaaaaatcggcttctgcaacagaagccgattcgcttgatgacccgtacgggattcgaacccgtgttaccgccgtgaaagggcggtgtcttaaccgcttgaccaacgggccagatatatatggtagcggcggaggggatcgaacccccgacctcacgggtatgaaccgtacgctctagccagctgagctacaccgccatataggtgcttataagcacaagttatataatacaaaggtttcttcattccgtcaacagaaactttaaagttttaattttctgactacatgcgcgtatacaaaaaaagcacccgctgggatagacggatgctccatgtatttatagaaagcagcaagttatcctcttcttgctccgcgccctccacgttttgattccgtgtttcgttttaaagatgataagcggtcttcgctatctttaagaaacttgttcattttctgttcaaaagattctttcggacggaaatcatttctaggtctggcttgcggacggtctttagcttttttaattgataaaccaattttcccgtctttttcaacgttgatgactttcacttcaacttgatcgccgacttttaaatgctcgttaatgtcttttacataattatcggctacctcactgatatgaacgagaccggttgagcctccaggcaattcaacaaatgctccgaaatttgtaatacctgttattttcccttgcaacttgctgccaacttcaatcgacataaaaaaagtgctcctccttaggcttataaaaagatcgtttgtttaattatacctaaataaaaatttaagtgtcaacaaggctacttgctcttcttttctacattaaagagaatctcaccatttcctgacataaacaagtctcttctggcaagctctgtgacgtaatcctcatcctttaatttggaaatttcatcttttaaatcagcctgtttcgcattcaattctttaacttgtttttccagctgagcctttttttcttcgtttgcgctaagggaagaggtctgtgaccacagagaacccgctaagacaatagccgtcaacaacacaagggcgccgaatacgatcaaccgtctgaaaagccctttccgccttcttttcataagctgggattgccgttcaacctgctctttatagtcgttttgaatttcagttattgtacgttccctagatagattcaaaccagacggtcctcctttcaccttttcaaaatacgtatcatggtcgatctgattgttatgattagtttcttgctcttttgtaaaaatcctgcacttttttgaaaatatcgtttgaaagtaagacgccacttttcaggaagaagtttcaataattgtttcaacaggaaaaacagcggatacagcaaaaacgctacgatcttaaaaagacacttcgcaaaaaaggcactcacccgataggagtataaagaaataaccgtgatcagcccgatgagcagcttaaagagcagaagcaccggacggaacagcacgtgctgaatgagcttttttgcgaattggtaaagagacaccgcaagatgaatggcaaatttcagtatttttatatacattcgtttaaacaggctttggtacgtcgcaatacccagtaagacagccaagaaaatgtataccctgagttccccttcattcacgttgagcagcacatagaaaaacagcagaccttgtacaatccaaaagagaatgtcatgaatgaataacagccatctggccgttttggcgcggctgacaaacagcctgtatgtatcaagcgacgctccgagccaggcgcccataccggtcattgccagcatcgtataaaattgggtcgtcagcgtcatttaaacaacttgctaaaaaaccctttagctttatccccttgctgctcgtctaaatatacaaggtcaaacaccctgccttttatagatacaatccctttttccacatcaaggtttttcatctgcagattctcgcctctgacggaaagcattcccataaccgtttccagcaaaaactcttcgttatcaaaactttccacatgcttgacgcccgaaatgtctaaatgctttctccctttcatcgttacatcatgctgttccggaacagaagaagaacctttttgctcataatatgaattcatctattcagcccccatatcctcgatacttttagcattattactgcattgtatgaggcgggagccttgtttagaacaagcctattcgccgagtttttcttctttgacgattgtatacatgcccgcggcttcttcttttttcgttgtttctttcaattcatttaccttcacggtgacaagcttctgcccgaagcggaccttcagttcatcaccggcttttacgtctgagctggctttcgcctgattcccgttaacggtgattctcccttgatcggcgacctctttcgccaatgtgcgtcgcttaattaatctggatacttttaaaaatttatcaagtctcatatcagaatctcctctccatttcttttgcttcatcccacaatttgtccatttcctcaagtgacattgcggtcaattcaaggccctttgctgccgcttctttctcaatataagcaaagcgtctgcggaatttgtcatttgtcatggcgagcgcttcctcaggctcaattttatagtatcggccgatattgaccaatgcaaataaaacatcgccgaattcagcttttaagctgatttcatctgctgattcggcggaagcctctgcagaaaattccttcagctcttcatttactttatcccatatgtcctgaacgttatcccagtcaaagccggtttttgcggcttttttctgaagcttggcggctttcgcaagagaaggcagtgttttcggcacggcatccagcaatgaagaggatgttgtttgcttttccgcctttttgatttcttcccagttggcgacgacatcatgttcatcctgaaccttaacatccttaaacacatgcgggtgccgtctgaccatcttcgcactgatgtctctgatgacatcatcaattgagaaatacccctcgtcttctccgatctgggcgtgcagcataacctgaagcatgacgtccccgagttcttctatcatgtgatccgtgtcctcttcgtcaatggcctcaagcagttcgtagcattcctcaatcatatatttctttaatgactggtgtgtctgcttttgatcccacggacagccgttcggcccgcgaagctcgcgaataatacttcggaatgcagaaaattcctggtaaaggagttcttcttttttaatcggcggaacatacacgcttgttaagttatttatttctacattgcggtcaagttcaaacaaaggcaccttgatcatcttttctcccttgctcccggctgctgtaacgatgaccacttcatagtcgtcaggcaatttctccatgagcgtcagcttcacctcagaggccgtcatttggtcataaacctggcagatgatcaggtgatgccggagttcgagctcatccggcgtcattgtttgcgcatccgtaaattgaaacccttcaatcggatcaattcgcaacgcattaaaagtggcatccagaaagctttgccctccagcggtatgaacatctatctgttgttcttcccggcgttcaaataacagctgaacggttttctcagcgacaaacggatgcccgggtacagcgtagacgacatcctcttgcttcgctttttcaaacagaatgtccgcgatctcttcatagaccgcttcaaactgatcatgtttttcataaatatcatcaaaataccggatgtccgcttccgtctcttgctctaattccgaaatcaaagggtggtctttcgttcttatatataaatgcttcgcctgagtcagcagcttatgtacgcccactgtcaactgatccatgtctccggcgccgaggccgacgaccgtaatattacctgccatgtttttctctcctctttttcaatttgcttaaagcactgccgaaaggaagaccgctcagctcttcgtccgtgaaaatcttcattcttatcatacaataaataaacaatagccctccgatgattgacgcagacagactctcacatacagctccgcccctgctgacaggaacaaataactgccaaagcttcatgtatacgaccaaaaagaagaccatcagcagactgcaccagcacagacgggcaatcacgcctccgatattcgtcagccatcccttcgaccaaattctccggagattcaggcacgcaactgcggcaaatgccaagacggtcgccagtgccgctcctgtaataccccagccggggaccagccaaacattcagcacccatttcagcgcccctcccgccaaaacggatacggcggggaaaacggtatgtcccgctccttgcagaattgcggctgccgtaagcgcaatcgaggcaaaaaagatagataagctgaatatttgtaaggtcggcgtcccctcactgttttggaaaagcatgatattcaccggttctaaaatgcaaaaaagcccggctgatgcaccgatccctaccgcaaggcagagcttgacggcagatgacgctttctcttttatgataaacggcttgttctcatgcaccgcttttgaaattgaaggaaccaaggacgcggcgatactgacggcaaacacggttcccagctgaaggagcggctgtccgcggtcatatatgcctttcagctgtttcgcggcatggctctccgtcccgtctgaaagcagtgaatataagtttaaggcgtctacaagctgaatcaaaagcatgagtacactgctgatacagatggtgactgaataaagcagcagcttttttacaatgacggccgtttcgatatgtccgccgtctttctttgtttcttcccgcttataccagaaaacagccaatacacaaagggccgcaaagctcccggcaattgatcccgaggccgcccccgcacccgccgcgtataatgaacgcccgcttttcaaaagccagaaggataaaccgagaagcaccgccacccgaagaagctgttccgtaatctgggataaggctgacggcatcatatcatgcacgccttggaaatacccccggaaaaccgccgtaaacggaaacagtatgaaagcgaacgccgcgacccttatcagcatcacaaggcgggcatcacccataaaaccggccaacggcgccgcgccggcatacatgagcgcaaacagaacaagtccggccgccgtgacataaagggcggaaattttcattattttttgtttatgatcgctataatcgttcattaattttgagatgatcaccggaaaaccggatgttgacagcatgaccgcgatccctaaaaacggatacacctgctgataaatgtaaaatccgacgtcaccgacaatattctgaaaaggaaccctgtacacggcgcttaatatcttcgtcacgatgcccgcaacgacgagcacaaaagcacctttccatgccgattgccgcttggcgccaactgaatcgttcatccaaaagctccttccagccgctagaaaattacgtctataaaacgagcttattatatcacaatcctaacggccgaaccgatagagagcacatatgaatatgaaaaagaacagcacttgtataagagctgttctttccccgttttcttatttcaataatggtaataagacctactgctccatttgtctcgccaaaaaactggctgccgtttctaccgctttatgttctacttctccaagcgcctgttccttggaaaagatgaccacggcaccgataggatcgccatttgccacgatcggagcgattgtataggagctcatatcttcatcaatgtcattcacaagctgcgcggacttcacgtcgttttctaccactgagctgcgctgatccatcgttttttcgagcaaatcgctgatggctttattcagaaattcttttttcgaactgcccgaaacggcaatatacgcgtcacggtcgcaaatcaagacggaatggccgagactgtcatacaatgcatctgcatattctttcgcaaaatcgccaagctcactgataggagaatattttttcaatataacttctccgtcgcggtcaacgaatatttcaagcgggtctccttccctgattcgcagtgttctccgaatttctttaggaatgacgacccgtcctagatcatcaatacgacgtacgatacctgtagctttcatctctctggtgcctctctttcatgtgatgatatttaagggaaagtactaaagctctttactttatgtagcttccgccactcgcttgaaattagtatccgtcacatcaaatgtaatatacaccagagagtaacaatttttatgaagacgcgattgtttctttcttcacattctgaaggcctttcagcatgccgagcacggtctccagccactcttccgttttgcggcctttcgtctgtactgagattttcagctttttcccttccattcccagtccgatctgccggccgtatttattgccgagttcgaataatttctggccgtcaatctgtgcgctggcctcttcagaaatggtaaatctgatcgcgtctttatcctgcttgatgagttcgacgcgttcatattttccgtataccttcatctcagcaaccgtaaacagccattcaacttctttaggatagctgccgaacctgtcgatgatttcatcttggagctcatttttctcctcaattgtggcgattgatctgaagcgtttatacatgtcgattttttgcttgccgtcttgtatatagttttcaggaatatacgcgtcaagctcgatatcgatttctgtctcaaactgttcgcttttcggaatatcgcctttccgctcttcaatcgcttccttgagcatttgcgagtacaggtcaaaaccgactgagtcgataaagccgtgctgctgggcgccgagaaggttccccgctcccctgatcgtcaagtcacgcatggcgattttaaagcctgatcccagctcggtaaattctttaatcgcctgcagccgtttttccgccacctcagtaagcactttgtctctgcggtacgtaaaataagcgtaagcgacgcggttggaacggccgacccgtcctctcagctgatacagctgagacagccccattttgtctccgtcgaacacaatcaaggtattgacatttggtatatctacgcctgtctcaataatagtcgtgctgacaaggacgtctgattccccttccagaaaattgagcatgacgctttccaattcattttcggtcatttttccgtgggcatatgccacttttgcatcgggaacaagcatggaaatttcatcagccttccgctcgatgtcatccacgcggttgtacaggaaatatacctgtcctccgcgcgccagttctctttcgatagcttctcgtacaagcgcgccgttgtattccacgacatatgtctgaacagggaaacggttttccggcggcgtttcaataacggataaatcccgcacaccgagcatggacatatgaagcgtacgcggaatcggcgtcgctgtaagagtcagtacatcgacattggctttgatctgtttgattttttccttatgcgttacgccgaagcgctgctcttcatcaatgatgagcaagccgagatctttatagacgacgtctttagataagagcctgtgggttccgattacgatgtctaccgttccgtttttcagtcctttaatcgtttcattggattcttttctcgttctgaatcggctgagaagaccgatgttaatcggatagtcctgaaaacgctccgtaatggtttcataatgctgctgcgcgagtattgtcgtcggcacaagaagcgcgacctgctttccgtctgcgatcgctttaaaggccgctcggatggctacctccgtcttcccgtaacccacatcgccgcaaagcaaacggtccatcgggcgttctctttccatatcctttttaatctcctgaatggaacggagctggtcctctgtttcctggtaagggaaagcagattcgaactgccgctgcatttcatgatcgggcgagaacgcatagcctttgcttgcttcccgttccgcataaagcttaatcagatcatcggcaatatcctgaacggagttttcaacttttttcttcacccgtttccattcactgccgcccagtttataaagcttcggttcttttccttcagagccgacatacttctgcacctgatcgatttgttctacagggacatacagcttatcgctgccctgataatgaatgttgaggtaatctttatgaatgcctttgatttccagtgtttcgatccccaagtacttaccgatcccgtggttgacgtggacgacatagtcaccgacctgaagctcggaatagcttttgatccgttcggcatttgtcagcttctgctttctcggctttttcttgattcggtttttgaacagctcttcctccgtaatgacggccagcttcatcagcggcagttcaaaaccggattgcagctcgccttccatgacatagacctgtccttgcacaagcgctttggagctgtccgttttcgcggcttcaatttcgtaatcagccagcacggatgccaatctgtcggttctgtccttatttgcgcctaaaaagacgacggtgaagtttgatttcttaaagcgctccatttcacctgagaggacattcatctgcccgtgaaaactctgcatctgccggcttgtcacattcacgatattctgagggcttgtatgctggacatgacgcaaaaataatgaataataaatagccgggcgccgcttttcgctcataagctcctgaaagctgaaggataaatgaatgtcatgcagaattttcccttcctcgagcagacttgtcgtaaattcggcctcttctttttgcagctgatcctccatttcatgaatgcggctgacctcgtctaacaataacaacgtgtctgccggtgtataatctagcaaactagcaggtttttcgtaaaagtacgagagatacttcacaagttcctgatcagtctgtcccgttgataaccgttctttatcatgtgagatattgatatgaagcatttccttttgtttgtcctgcttcagctttttcagactgtcggcaagccctttatcgagcctttccattgcccgggctttttcttccgccctgatgatcaattccttcgccggtccgatcgccacatgtttgagcgtctcgattgatctctggtcatcagaattgaagcttctgatggaatcgacctccgtatcaaacagttcaattcgcaccggatgctccgacgtcagcggataaatgtcgataattccgccgcgaatactgaattcaccgggtgcagaaaccatatcggaacgctcataccccacctctacaaggcgcgcggacagctgatccggttctatatcgtctccgagtgaaatgacgagctggctgcttttccacagctccttcggcggaagcattcttctcactgccgcaacgggcgccacaacgaccggcgcttctccgtttgttaatctattaatgacatcaagccgctgagcgcgcagttcaggactcgctaccgcaatttctgaagaaatcaattcattcacggggtataaaaaaacagattgatccccgagaagcgccgtcagatcttccgtcactttttgggcctgatataaattatgggtgataaagaaaatcggccttttcgtttcctgtgcaagggcggaggtaaaaacagaacgcgcggaacctgacagacccgcaagcagctgttccttcagcccctcatgtaaaccgttgacaatggatttaaaatcatcgctttctttaataaaggtttgaatgttgtccatatgggccctcctctctattttctgcaagaacagaaaaacgctttggtctagaatctacaccaaagcttcttattgaataaatgtgttgtgttcatggtagtgcggattgcgttccagcgcctcttggcagtcttcacaaattgtaagaacatggacatctccattgtctttatatgaaatcatatcgtttctttcctcatttgttaagtgctgaaatccaagtgactgtgtcggcaccgttgaatattccaggctccctaccttaaagccgcagtggcggcagaaataatgcaaagccatacgttggacctcctgatgtgaaaaaatcatttttccctagtatggtctcccattatttatcttatacatttgcattaaattcgttcatgacttctaaaaatggtttcgttaaggaagcttcgcaggcttttacggtttttgagacggcatcattgatatgcggcgcttcttccttcgtaaaagctcccagtacatagtcaacgactttcattccgttaacggggcggccgattccgattctgacccggtcaaattcaggggttccgaggtgctgtataagcgatttaattccgttatgtccccctgcgctccccttcgtccgaagcctgatttttcccgtcggaagatcaaggtcatcgtatatgactttcagatcttcatgatcggcatcataataatccagcagcggccgcaaacattctcctgataaattcatatatgtaagcggtttaacaagtagaactttttttccggaaacaaaccccattccgtaaagtccgttgaatttcgttttattcagttcaatattccattctttagaaagctcgtcaatggccataaagccgacattatgcctcgtgttctcataggtttttcccgggttaccgagaccggcaatcacaagcatcgtaaatcctccctcaacatcgctgtaattcttctcattctagcacaaaagacgtaacctcgggcgggttacgtcttaaagcgcttattgattttctccttcgggctcttcctcaggagacggttctgcatcttcttcgaatgcttcctgcttaggaggaaggatggaagccacgacttcttccgggtcgtttgtaaatgtataattgccgtcagcagtcagatctgcgatggtcagcacatcattcatttcaagcccggaaatatcaacattaattgtctgagggatgtccttcggcttagccttgatcgaaagctcatgcagcggctgctggataacgcctccgtctttgactcctttcgcctctcccgtcagctgaatcggcacctcggcctcgagctcctcactcatattcacgacttgaaaatcggcgtgcgtcaattcgtttttgagcgggtctgtctgaagatcagtcaccataaccgattgctgatttccgttgacatcaattgtgataatcgtgttttttccttcgtcccgcaatgttttaagcaattcgacactgtctaaagagacaggcgtattcgttatttctttaccgtatataatccctggaacatgtcctgaatgacggattttccgaagcgtcgaacgtttaaaatctgttctttcatttgcttttaaagttgccatattcagcaccatcctaattatcgttttatcgtcctattagaacaatacccacaataactgggatttaaaccttaaagtttcggtttagctgaataaatagctgacagattgtttctcgtgaacgcggataatcgcttcagccagaagcggtccgacagaaagctgcttaaagcggtcgatttttttctcatcaggaagcttaatgctgttcgttacgacaagctccttgattttagagttattgatccgctcaacggcagggcctgacaatacagggtgcgtacagcatgcatacacttctgcagctccgttttcaaccagcgcgttagcggcaagtgtgattgtgccggccgtatcaataatatcatcgatcagaatcgctgtttttccttccacgttaccgacgatgttcatcacttctacctcattcggtctaggacggcgtttgtcgataatcgcgatcggcgctttcagacggtccgcaagtttgcgggcgcgcgtcacaccgccgtggtcaggagaaacaataacgatatctttcaagtctttaccttcaaagtaatggcctaaaatcggaacacccattaagtggtcaatcggaatatcaaagaaaccttgaatttgcggcgcgtgtaaatcaagcgcaatcacgcgtgtcgcacccgctgtttcaagcaggtttgcaaaaagttttgccgtaatcggttcacgtgatcttgcttttctgtcctggcgcgcataaccgtagtacggaatcacaatgttgattgttttcgcggaagcgcgctttagagcgtcaaccataatcagcaattccataatgtgctcattaaccggcgcacttgtagactgaatgatatagcaatcacagccgcgaatactttcttctatgttgatctggacctctccgtcactgaatcttgtaacagagcactttcctaattgaacccctacattatccgcgatttcttttgcaagttctggatttgaattcaaagaaaaaatctttaaattcttatctccgtattcgttagacatggtaaacctccgattttaggattattttttatgaatatttttcacataatcttctttatttacttgtcttgctctggcaatggcaagcgcttcgcccggcacatcttcagttacggttgaacccgcagcgacatacgcgccttctcccactgtgacaggagcgaccagattggagttgcagcctataaaagcgccgtcttcaatcttggttaaatattttttcttcccatcataattgaccgtgatggagccgcagcccagattcacatccgtgcccacttcggcatcaccgatatagcttaaatgagatgctttgcttcggtcgccgaattgtgttttcttgatttcaacaaagtttccgatcttcacttcattgccgattgcggaatcgggtctgatgtgagcaaaaggaccgatatttacatcattcccaactttgctgcggttgacaacggattgtttaatcacagtgcggctgccgattgaactgtcctctatctcagtgtgagggccgatgacacattcatcgccgatttcagcttgtccctttaacacagttccgggataaataactgtatcttgtccgatacgcgcgtcaggtgagatgtacgtattcatcggatcgattaaagtgactccgttctgcatatgccgtttgttaatacgctctttcatatacatttcagcctgagaaagagcgactctatcattcactccgagcgtctcttggaagttaccagtctggtaagcggcaacagtttcgccttcgtctttgaggatttcgatcacatccggcagataatactcgccttgggcattttcattcgaaacctgttcgatgacacgaaaaagagcctcgttatcaaaacagtacgttcccgtgttgatttctttcacaagacgttcttgctccgaagcatccttgtgctccacgattttttgaacggcgccgtcttcactgcggatgattcttccgtatccggcgggatcgtcggcaacggccgttaacaccgtggcttttgcacctttgtctgtatgttcattcagcatggcttccatcgtctccgccgtcagaagcggtgtatcgccgcaaataacgatcgtgacacccttttctccgtgaagaaatggttttgcctgcttgaccgcatgagccgtaccgagctgttctgcttggagagcgtaatcgcttttctgtccgagctgcttcttcacatcttcggcgccgtgtcctacgatggtgacaagcttcgctaaagataatttcagagcttcgtctgcgacgtgctctaccataggctttccgcataccggatgaaggaccttataaagcttcgatttcattctcgttccttttccggcagctaaaatcactgcaaaccgcttatccatttaatggcctccaatatcccttttatccatagaaaaatatatcctaaatagctgttgatttcaagaagacatcaaaaagtgcaagaattttctatgtaatcgctttattactgaaaaatcagatttaaaaaaggactgccggaaaaggccttgtgtcagcctttatcagcagtccttacattttgttatgtttaagaagccccggcttcttcatattctaatgcttcagaatcacccaaacgatgatactcatttaaaacagcatcctggatcttgccccgcgtgctggaattaataggatgagcaatatcgcggaattctccatcaggggtgcgtttactcggcatcgcaacgaaaagaccattgtttccatcaatcacacgaatatcatgtacgacaaattcgtgatccagcgtgatggatgcaatcgctctcatgcgaccatcggtattcacgcggcgtaatcttacgtcagtaacttccacagtagttcaccaccttttccctatataaaagcattagtctaacaattccacgattctttttaaattcctgcacgtttcaaaaagtttttttgaaaatataggatatacatacacaattaggtgataaaccatatttggggatcatatactgcataaaaaaagtgatcccggagaccggaaccacttttctgagatttaagattttaccagcgcaatgacttcaatttccacgagagcgtctttcggcagtctcgccacttccacacaagaccttgccggcttatgtacatcaaagtattgtccgtacacttcattcacttccgcaaactgctccatatcagcaataaataccgttgctttgacaaccgtctcgagagaagcgcccgcttctttcagcacagcttttaaattgctgaacacctgatgcgtttgttctgtgatatcaccgtttaccatttctccttcagcagtaagaggaatctggcctgagctgtaaaacatgttgtttacgatgattccctgtgaatatggcccgatcgctgccggcgcgtgtttcgtatggattgctttagtcatttttctgtctccccattctttaaatgctgttctttaaaaaatcgcagaaaattgccgttttgaatctcaatcgttttgtctttcatattgatggttgaaagcgtgagcagtgacatgtattcatcgacaagccgttcattcactccctcggcttcaaccaagacgcctatccccgcgacgtttgcattaaactcatcaagcaggctgatcatgccgttaatggtgccgccggctttcataaagtcgtcaataatcaaaacgttcgaacccgtagccaaacttcttttcgcaagcgacattgtttgaatgcggttagacgatcctgatacataattgatgctcaccgtggagccttcagtcactttattgtcctttcgtacgatgacaaccggaacgttcagataactggccgctgcgtaagcaagagggattccttttgtcgcaacggtcatcaccacatcaatctcccgctccgcaaaaacggaagcaaaaagcctgcctacatgagagaggacagatggttttcctaagatatccgttaaatatacataaccgcccggaaggatacgctcaggatttactaaagactgtcccagctcctgtataaacgcttctgcttcagcctgtttcactttcggaatgtatttgacgcctccggcagctcccggcactgtaagcagcgtcccaatgccttgctgttcaaaggtctgtttaataatcgttaaatcttcactgattgatgactttgctgattgataccgttctgagaaaaacgttaacggtattaattcatgcggatgggttaacaaataatttgttaagtccaccaatctgccgctgcgacgaaacttcatgaacttacccccaaaatccgaataatttaaaaataatataacttaacatacggatttaatcaagagcattctgttcgccgatcatccgcaccgcgtacacttgatcacagaaacctcttaacccgttataaatccgctgcacctttgattcgtattgaaccaaaccgaatacagtcggtccgcttccgctcattaacaccgcatcagcgccgaagcgtttcatttgatttttaatcatcgccacctcgggatggaggctgagcgtaaccgactccaatacgtttcctaattgtccgcataccttttggaagcttttttcttcaatcgcgtcaatcatcgcctgcacatcaggatgccgaacctgctgtaagttcagccggcggtacacttcggcagtcgataccccgatcgtcggtttggcgagcatgacccagcaatgaggcggagcactgatgtgcctgatcttctcaccgcgtccggttgccagggcagtgcctccgtatacacagaaggacacgtctgaaccgatttcagctccaagctctgcaagctcttcgacagaaagctttaaatcccaaagcctgttcagccctctgagcgtagctgccgcatcgctgcttccgccggcaagccctgccgctacagggatcacctttgtaatcataatcgaaacgccttttttaacttgaaaccgttctttaagcagtttggctgcctgataagccagattcctttgatcatccggaacaaagcgattatgcgacgccactctgataacgttttcgggcagttctgtcagttcaatccgatctgccaaatcaattgtcgtcatgatcatctccacttcgtgataaccatccgggcgtttactcgtcacatcgagggacagattgattttggccggcgctttttctaaaatacgcatagctttcacctacttctccatctaaacataagtatgaacattgtatcacatttggagacccggaggtacttatccgaaattgacgccggttttgacagccgatagaaaaaaccggggaacggattgtcccccgggccactgcattatcggttattttggttctgagccgccatctgctgttcggcaatctcgatcgcgcgctttaccatattcccggcgtcacgcgcccgaatgcctccccagccctcgtttttcaccgtatcgtaaaaaccaaggtccttcgccagctcatatttgaactcatctgacataactccacgacgtctgcccaaacgaaacaaccccttttatagaattgatcaccattcgtgcacgccacgataaaacatgtgacacctatagcttccgtttaatcggctgaaactttcgagggaataattagaagagctttagaaggcaaaacaaaaagcagtaaacaaaaggttcactgcccattaaaatgctactgagcttgccgcatcgtcattgaatgtcaattcaacagtctcagtcagaatatcagcataactgtatgaaactctttcaaacgaattctcgtcttgatctagttgtatcacaaaaacagaagggtacgtctcagctaaaatgcccgaacgctcaatcgtttttcggcggccgccgtttgcttttaacgtaagccgtttacctaaattcccatcaagcgatctttttatatcggacaacgtcttcgccattgcatccacctcactacatttattgtacaacaagagcccaattttgtcaaataaaatttaaattatatcaacgttaataagtcattgtcaacaaaattattttgacaaaattctattgatttctgcgttatttttcacaagttccggaaatttatgtatcaatatgtaaaataattaacccgcatagcgaaatatatgcgggttttatcactcatccatttgatttatacggcataccgacacgcagcacacccttcgtttcaattcctcccagccctttctctctcgtcagcgtatttctcaggacatcccatacattgatccgctccataaacggagtgaagctgattttcgcgacaatatataccgggtcaagcgcatgaatattgacgcgtgacggcgaacttgcgaaattcgcgcccgctctgattaaagactcaaaatgagattggcacgcccccgcgaatatgaccagctgatccaaatgagggactttacgcctcgctctctgaacggtttcgacaaagtgtttggaatgcctgtaggcgcttaaatcgttcacgcctcccttatgcttggaatatgcatcatggccggtgatgactaaaatatccggcctgtatttatcaagcagctcgtcaattgacgccggcatttttttctcatggcaatgaattccgtataccggcacaccgattttttcataaaagttcaggcactttttcaaataggcctcatcgccgtccagatgcaatacctttccgggcatatgaaagtagtgctcctgatgctgatattgatttgtcgcgtaatactcctgtttttcccgaagcagcttataatcctggcggagcagctcgagagattcattcatcctgctttcatctcttttctttctcatggcctgttcgtcttttctgacaggctccaaatcagaaaaatcagcatccgcaatcaatctgacttcgtcaccatgcaggatggcaattgaatttccgttgcttgtttgctctataccgataatgcgaaataaaacatccatttgataggatttcctggctaccatatctcctatttgaaattgcacgttacccactccacaaatagactaagcctcatcatgaaagaagtcttggcaaatgcacctctttccgctgcggcgcttgatgtttcaagcttttcttgcagttgaatgaataaggttctcctctagcctatgtagcggcagtccaagtggtgacgcaaaacaaaaagccctcttagaaaagggctttatgcaatccgttggacaagagcgcgaattcttctatggacagggattcaccgcgtcgctttccatcaatattcgtttcttgaagaacttcttcaatttgagcttttttctcttttccgcccggaagattgttcacaaggttgttcagcaaggttttccggcgctgtgcgaagcttgctttaatcagctggaagaaaaacggttcattatcgacgtcaaccgccgggccgtcacgaagcaagagacggatgacggcggaatcgacattaggctgaggcacaaacaccgttttcggtacggtcatgacggttttggcctccgtatagaactgaaccgcaatggaaagcgatccgtactccttagaggaaggatcagcggccatccgctcagcgacctctttttgcagcattacgacaattccttttaacggaagatgttcttccaaaagcttcatgatgatcggcgtcgtcacataatatgggagattcgccgtcaccataatttcatcacaatcctgaaactgctcttcaatgacggatttgacgtctgctttcagcacatcttgatgaatgatcgttacattgtcatacggagacagcgtatcattgagaatgggcagcagacgctgatcaatttcaaacgcgacgacctttttcgcccgtttggcaagctgctctgtcaacgcgccgattccgggcccgatttcaatgactccggtccgatccgtaatttccgcatggtccacaattctgtccaatatatttgtatcaattaagaaattctgtcccagactctttttaaaagagaaaccgtactttttcagaatttccttcgttctgataggtgtcgcgatatctttattgttcatcctgttcctcctgcctcatagcatcgagcgcatcaataaaatcacttcttttgatttgaaacatttgcagccgtttttgaagctgcttgccgtttgtatagccgatcttcagcaggtcgcccaatcgttcgcgccgtcttttggcagccggtccgccgatcagaccggcctgtatgacatcttcagctgaaatttcactcggctttgcctccatctcttcatgcacattttccagacatgctctgatgctttcaatggatgcgtgctcaacgccaatgccgcgcttgtttttcggtttggcaagatgtttgggcagaaatgcgtgtttacagccgggtactgcttcagaaatggttttccggatcttctcccccggaaaatccgggtccgtcagcacgatgacccctctcgtttcctgcgccagccgaatctgcctgatgacttcgtctccgattgcggaaccgtttgtctcgatcgtatccgcatcaacggcaagttttatgcgcgcagtgtcatcgcgtccctcgactactataatttctttaattttcattacttcctccaaaaaaactttttatatccaaaacgaaacctttgcttgcatgtcacgtctaatatactgaaaatacactttacctattataacgaaaaaaacagagggcgcaaaaccctctgaatgaatcggaattaatttaagatttttattttgacctgtttctttccccagcggtaagctgaagatttttcagggaaaaagacatcaatccgtcttcctttaatggctgagcctgtatcagcggctacggcatccccgtatccgtctacgtggactcttgtgccgagcgggatgacgcttgggtctaccgcaatgactttggcattcggattgcttgtcaggttaacgcctgtagccgtttggccggaacagccgctgcagcttgcggtataagccgtggaagacacggtaatcactttaccggaagatccggtttcgcccgaagatgccttcacaggtgcactgagctgctcaatcttgggactgtgccgctttgtgccgaccgcaatgatctgatctttgcttttttcagatgtttcttctttgacaagctttcttgatacttcttttccattttctttgacaacatgaaaatgctttttaagtttgccttcttttcctttttgaacgatcttttctttcccgctgtcgagagacgcatcttctttttctttcacttgatacgctattttttcctcaactacatcggtgactttttcgatacgagtgatttgtatgccggcctgattttttgtgagcttttcgtgtaatgccggttttactttatcttcgtctttcatgtccatcttatgctgcgttaaaaagtcagcgaccgtagtcgaagtcgtccatattttctttttctttcccgcatcatttacagtgacctgaaaagccgggtcgaccgtgactttcatgccgtttgtcactttcgtatctgctgctggatctattttatcgtgctgattcacaggtgtatgctgttcgttcagaaatgcgccgactgtttttgccgttgaccataaagtcttttcttctccgcctcttgtcacacggatctgctttgcagcatcatacacgacattcatgttgtctgccaatgctgtctgcttagacggggtaatccggtcttcatttctcgtctctatatgtaaatcttccagaagttccccaaccgtttttgcatgagtgcgtatttgctttttcttgccgttgatggaaacagaaactgattgttttgagagctcatgtgccccgtatgcagtcccggttccgcccagcagaataatagctgcaatcagaataaccttgcttttaccaagctttacggaaaacagttttttcattttttgtgtgatgaaaaacgcctccttctcctcggagagattatatagagtatctaaaatgctgtcaaccctcccatctcgaagatgaaaaaccttcagcgtatccctcattatgcaaaaacaaagcaaaaaaaggaagagagacatatcgacaacctatcttatgaggagaaggaagcttgtagaaccgttttacatatccactgaatcggacaagcttttacacgttatgacagcgcattctgtcagttcatgcggaaaagtctttttgcgttttcggttgtaattgaggcaatttcttcatatgtcagcccttttaattcagcgagctgttcagcaacatattttacgtagcttggctcatttcgtttgccgcggaaaggatgcggtgtcaggaaaggacagtccgtttcaatcagcaaacggtcattcggaatttcctttgctacttcttttggtttcttcgcatttttgaaggtaaccggtccgccgaatgaaatatagaaattcatatccatacactgccgtgcaacctccgtgctccccgtaaagcagtgcataatgccgccgacttcttccgctccctcttctttcaaaattgtgacaacatcttccgttgcatcacgattatgaatgataattggaaggttcacttctttggcgagagcgatttgtttccggaatacttctttctgaatgtcttttggtgatttatcccagtggtaatcaaggcccatctctccgatcgccacgactttttcgtgagaggacagttccttaatccatgataaatcttcctctgtcatgtcaattgcgtctaccggatgccagccgatcgcagcgtatataaagtcatattcctcaatcagctccatcgcacgcgtgatagtgggtttgtcgaatccgacaacgacaattcgttcaactttttcagcctttgcacgcgcaatgacttcctctaagtctgtgtcaaattgctcggcatttaagtgcgcatgtgtatcaaaaagcatcataaaaactcctttcttgttgaaaaacaaaaggtgttcgacggaatgttacacgtgaaacaccttttgcccctattatttaattcgagtgcctttcggtaatgactggtcgacagctacaactttgagaacgccgtccgattctcccgccagtatcattccttgagaaagctcgcctctcagttttaccggttttaaattcgttacacagatgatcttcattcccacaagctgatccggtgtgtaatgcttcgcgatacctgatacaacttggcgctgttcaaagcccagatcaatttgcaatttcagcagccgatctgcttttttcaccggttccgcggacaagacttctgcgacgcgaagttctgtatccataaattgatcaaacgtaatttcaggaagacgctctgcttcttgcggctcttccgccttttcttctttagcaggagcagttccttgcattttttgcttgatgtaagctacttcttcttcagcttcaagacgagggaaaagcggttccccttttttcactttcacattcttcaattggccgaatgtctgaatgctgtcccaagctttaagagactgatcctcaactccgagctgggaaaacattttttcaggcgtctgcgtcaagaaaggctgtagcaatacggccgaaatacgcaatgattcagctaaatgatacatgacagaacgtaattctttttctttttcctgatctttagcaagcacccacggagcagtttcatcaatatatttgttcgtacggctgattaattgccatagcgttgataaagctactgaaaactccatgttttccattgccttttcataagctttaaccgtttcaccggctacggaagaaagctctgaatcaaaatcggtcacatttccttcatatgaaccaatctcgccgtcaaaatatttttggatcattgcgactgtacgattcagaaggtttcctaagtcgttcgccaagtcataattaatccgttctacgaaaccttccggcgtaaagacaccgtctgaaccgaacggtacttcgcgaagcaggtaatagcgaagttcatccaagccgtagcgttcaattaacgttaccggatcaacgacatttccttttgatttcgacatttttccgtctttcatcaataaccagccatgcgcgaatacttgcttaggcagcgggagatcaagcgccatcagcataatcggccagtaaatggtatgaaaacggacaatttctttaccgacaaggtggacgtcagccggccagtactttttgtaaagctcatcattttccgtatcgtaaccgagcgctgtaatatagttgaacagtgcgtcaatccatacatacacgacatgcttcggatttcccggcacttttacgccccagtcgaacgtcgttctggaaacggccaaatcttcaagccccggtttaatgaagttgttaatcatttcatttttgcgtgattcaggctggatgaaagaaggattttcctcataaaacttcagcaggcggtctgcatatttgctcatgcggaagaagtatgactcctctttgattaattcgaccgggtggccgctgtcagggctttttccgccgacaacctcacccttctcatttcgttccacatccaccagctgtgtttccgtatagaatgtttcatcagggatgctgtaccagccctcatactcatccaggtaaatgtcaccattatcaagaagtttttgaaacactttctcgataatttctttgtgccggctttccgtcgtccggatgaaatcatcgtgagaaatgtcgagctgcttccatagcttttggatttcagcaactgcgcgatccacataagcttgaggcgtgatattctcttcctccgctttctgctggattttctgtccgtgctcatccgttccggttaagtagcgtacgtcaaatccttttaatcttttgtaacgcgccatcgcatcgcctgccacggtagtataagcatggccgatatgtaattttccgctcggataatatatcggggtcgtaatataaaaagtattattgtcttgcggcatgttgcaacctcccattcagaatgtcgaaaagctcacgcccaaaggacgagagcggttttatttgatatacaatattgatatttgtcctctatctatgataccatcttagcctttaagatcaaggatatatacgtactgcgcgtaaaagagtaaataaaattaaaaatttttattgaaattaaaaaaagtcttaacatgtcgaaatttgtcgtatataatctactaatataaaacatcttggttcgaaagtcttgatttaaaaggattttcagtaggataataggttcgaaaaagcagtcaaaaagcctgttatttcaggatttccaaggctttacttactataagaactaattcttacaaacaatagcaaacaaaaagattgacgattattggaaaccttgttatgctaggaatgtaaggaattttgtcgaataatgacgaagaaaaatataaactacaaataattatctctcgggaggagactgttaatgaaatctactggtatcgtacgtaaagttgatgaacttggacgcgtcgttatccctatcgaacttcgccgtacactgggcatcgcagaaaaagacgctcttgaaatttatgttgatgatgaaaaaatcatccttaaaaaatataaaccaaacatgacttgccaagtaactggtgaagtttctgatgataaccttaaacttgccggcggcaaattggtactcagcaaagaaggcgctgagcaaatcatctctgaaattcaaaaccagcttcaaaaccaaaaataagctatttcatacaaaaaccgttcttgttatgacacaagaacggttttttttatgattgaatgtgataagcgtcataaatctcgcgtttcggtacgtcccgatctaccgctgtttgttttatggcctgtttggaagaagatccttcatttatgtaatgctccacatgttctttctcagaaagctccgcccaccaaggcttttcctcttcatccggttcagcgccttgattgccttcgacaacgagacaaaactcaccgcggatttgatcttcatttgcccattcaagcacctcggcgatggttcctctgatgaattcctcatactttttcgttaattccctcgtgacggcgatggttcgattacccaaaacgtcatgcattgctgttaatgtttcttttaatctgtgcggcgcttcgtaaaatatcatcgtttcctgccgttttttcaggatttcgagttctttcttcttttcttttttttgtctgtttaagaatccgtagaagaaaaacggctgcggggtgatccctgatgcagtcagcgcggttaatgccgcatttgcacccggaagcggaacgacatatccgccgatttgggtgaaatctctcacaatctcagcccccgggtcggaaattgtcggcataccggcatcactgaccaatgccacattctttccgcttttcagccattcaatgattttatggccgctgctttctttattatgttcatgatagctgatgagagatgtttctatgtcataaacatggcacagctttttcgtctgtctcgtatcttcggcagctatgacatcggccgatttcagcgtctctactgcacgaaaggtcatgtcctccaaattgccgatcggtgtaggaacaaggtacagagttcccatttcagattttccgttaaaactcatctgacgtcttaacatatacagcctccttgctgcgtcgtttttcttctatatattgctcttttttctttcgggtcagctgcttaaaacggtattccgcctgcatcgcttcccgttttgtttcaaatgattccgcatggcataacgaaaccggccttctcgcccttgtatatttcgcgccctttccctcattgtgggttttcagccgtttttgcagatcatttgtataaccggcatacagactgttgtcattgcacagcagcacataaaagaaatgactatttgtctccatataaaatcgtgcggatctctttcgtatattcattttgttcattatatacaaagagcgggggaagaattttgagatcagggcggccgcctttaattccttcaaccaaaatggtattcgcttctttaccttgtttcggataaataaactgaacccgtttcggttctattcggtatgctttcattagttcaaagatttccagaagcctccccggccgatgaacgagagccgcttttcctccttgcttcagcagtttgctgctgacggaaatcacatcttcaagcgtgcaaaggatttcgtgccttgcgattctgagatgctcgttcaggttctgctccgcctctttcggtgttttaaaataaggcggattgcaggtgacaacatcatatttattatgtccgagtctttccggcatatttttcagatcatcatgaatgagactgatctgaccgcccagcccgttgtattccacgcttcgaagcgccatatcatacaagcgttcctgaatttcaactccggtgatatcggcttttgaccttgtgctgagcaaaagcggcacaatgccgttccccgtgcataaatcaacaatgttccccttttgaatcggaacgtatgcaaacttagacagcagcacggcatctaatgaaaaagcgaaaaccgtcggactctgtactattttcatatcctctgctaataagtaatccaatctttcatcatcacgtaatgaaaccataatcttattcctttcggcactctttgaaaaaggcttccgacatcagcggaagccttttccttattttttatttaagaaggacagacaaaaaaggcaatctcccttgcggacgctcccataatggacgttgcaaatatgaaagccttcttgatacagccgggccagattgtcgtacccttctcctatatcactctgctctgccttctgtgtttttgtttctttctgatcggctttgaacttctcaatttgctccgtcgtgtcatcaagccgcttacgcaaatgcttattttcaagctgaagatggtgattctcttcaatcatttcgccgatatgctgctttaagtcacccagctgacggtacagcgaaccgatttgttcctccaggtttatgacagtatcaaataactcttttttatccaaggttccacacctcgttaatctgtggtttgtgcggatacgacgccctcttccaagagctcttcccaagtatattctatcactttttcacgattcttcagttccacctgaagcacccgttccagaatattaagaccgacaacctttgcggggccgtttgccgtcgtaatcatttcgcctaaatccggcagctgttcttttgccgtctcatactcatcattttcatacttcaaacagcacatcaaacggccgcacagaccggaaatcttcgttgggttcaacgataaattttgatccttcgccattttgatggacaccggttcaaaatcaccgaggaacgtggagcagcaaagcattctcccgcatggtccgataccgccgagcattttcgcctcgtcccttaccccgatttgacgcaattcgattctcgttttaaagatagaagccaagtctttgaccaattccctgaaatcaacccgtccgtctgccgtaaagtaaaaaatgactttattgcggtcaaacgtaaattcaacatcaaccagcttcatatctaagccgtggtcagccacttttttctgacagacttcaaaagcggacagggcctcctgtttgttttcttctacaatgagaagatcgcgttcatcagcaacgcgaataacctttcgaagcggaagcacaacatcatgctcgtccacttgtttatttgcgatgacaacctgcccgtattctacacctcttacggtttcaacaatgacgcagctgtcttgttctatatcaaatccattcggatcaaaataataaattttccccgcttttttaaagcggacgcctattacgttgtacaagcttatccctcctgcaacgttaacaccaagtgctccattaatccctgcacattcacattggaatgaagccgtttttttgcttctaaaacagcgagaatttggttcgtaacgctttgttgtgtaaattgcagcgcatgctgttttattgattggaataagtcttgataaatcagtttatcttcatttccaatttggatggataatacatcacggtatatcaataagagcatatcaagacccatttcttgatgggttttttctttgaaaaagggcacccactgatcctgaatgaagaaaaaggcatgtcctttccgctgatgtaagacttcatacaattttatcactttcgctctggactctgcaaactcatcatttcgacttaattcgactgcttccgcaatattatttgtcatatttgctaagagccgggccatgtgagggctcacttcctgttcaatcagtctttcttctatggctttcggctgaagcggctggaacgggagaacctgacatctcgaaacgatggtatccagtattcggtggagctgctcagtaatcagaattgcgatggtgtcttgactcggctcctctaaaaacttcagcagactgtttgccgcatttgtggtcatttgatccgcatgggatataatgtacagctttttatgcgattccagccccgttttggaaaactcttcctgaagcgattggatctgagcctttttaatggataatccgtcgggctgaaccacatgcaggtcgggatggtttccggattcgatacgcttacagttccggcactctccgcaaggctcagtcccgtcttcaaggcaaaaaaagctttttgcgagaagcagtgcggcatccaatttgcccgtaccttttttgccttcaaacagatatgcgtgagaaagccttttcttttcaatgctgttatgcaaaagccgcatcactctgggctgctgcccggtcatttccttccatgatattgccattgtatcactctctatgtgtaaaggttaatcaataaaccttttatttctccgattcgatccagcaaatcaattgccggtttttcctgatctaacatttcttccgtcagctgaagcagtttttcatctatttctttcacaagccccagggtccggctgctgccgtacaagtcaaagcttttctccgtctcatgcgataatccgctgtctacggcctcttttacaaaacgttttaccaatcctttgaacttcgctaagtctttgaagtttctcgacttcgtcagccttttcccgaacgtttctatatccgttaagaacctgctcagctgatcaaatttcagcttgctgctttggctgtccattgaacttttaaacgttccggaaagctctgccgctttataagcaggctgctgctttttctcaataaatgtacgtaagtcagaatttattttcacgtcgtcaaatccttaaaattgatgaaattcatcgaccgggaggacaaagaccgtcgctccgccgacttccacttcgacgggatatggaacgtaggaatccgcattcccgcccatcggggataccggggcaatcatctgatcacgtttacagccattctctttaatgaggctgagcgctttatcgacacggatatcttccaccccgatcataaacgtcgtattgcctgatttaaggaatccgcctgttgtcgcaagcttcgtcaccctgaagttgtggtcggttaatactttcaaaagcctgttgctgtcctgatcctgcaccactgccactattaatttcattctctaggccccctttaggttggaaagaacattgtcgttacattcattatagcaacttatgagaaacaggtcacaactgaatttttttcaatgcttcatttatcacttgaagtgcgtcctgaatgacgagttccttctttttcgatgcgtcgattgtatggaatctttccggaaaacgctgcataaccttttggtatccttcccgtactttcgtgtgaaagtgcagagcctcaagatcgagacgattcttttctcttgaatcattcgacgtaatccgtttcaacccttcttcaggctcaatagaaaaatagatggtgacatcaggcatcgtatcgccgattgcaaactggttaatagaaagaacttcatcaatgccgagccctctcgcatagccttgataagccagcgaactgtcgatgaaacgatcacacagcacaatgcgcccttctttcaatgcaggctgcaccttttcggttaaatgctgtcttctcgccgcggcgtaaagcagcgcctccgtttttgcatccatcagtgtattgtttttatttaagatcacttctctgatctgttccgcaatgtcgatgccgcccggttctcttgtcgctgtcaccgggagcccctctgccgacagaatctctttcagttcctgaagcacagtcgttttccctgcaccttcaggaccttcaaatgttataaataaaccgctcatgatttctcctcttctatatagacaagtaattgttccccgtttaacaagccttgaatatgcgcgtccatgccgattaaacgggaaagcttctgtacgatctcttctgttatccgttcgccgtccatgatcagcggaattcccggcggataaggaataatgttccccgcatgcaagcgcccggccgccttatttatatctgcaggctcttttgtaaacttccgcatctcattttgcggatattcaagtgtcgaaatggacggaaatgtccaattcacggcatccggcaatttatcgggcggtgtattctccagtttctgctgtatgtttcttacggctgcctgttctatcatccgccggccgcctatcgacagtacgagcaatacttggtactcgtcagccagctcggcaacaatgccctcactctccaaaatgcgttgtaatgaatagccggaatgtccgagctttgaccgaagtattaattttaacgggtccgcccgcagcccatatccggaaggctcgattatttcaatagaagaaattgatgcgaaccttcgtttgattttctcaatgtgctccatatggacgggaagtgtccctttttcagcaatatcctgcacataagcacgcgccgtatctaaagatgccataatcgggtatgacgggctgctgctttgcaaactgcttacataataagttaatcgatctctgtcaattcgggtgctgtttaaatgaaagtaagatcccatcgtcatagccggaagcgttttgtgagccgattgaacaacggcgtccgcccccatagccaatgatgaaggcgggaaaggctgccctaacacaaagtgagctccatgagcctcatccaccagcacaggaacaccgtatgaatgggcttttttaactgccgcagtcaaatcggcggcgtgtccgtaataagtcggattggtcaaaacaagtcctttcgcgttcggatatgacgccagcgctttttcgatgactgaaagagatacatgtgccggcacatgcatattttcatcgatttccggcgccaaataaaccggcttggctccggccaatgccaccgcatggaaaacagacttgtgacaattacgctggatcagaatgggttcacccggttcacaaacagctaaaatcatcgccagattgccggcggtcgttccgttgacgagaaagaagctttcctgagagccgtacaatctgctcaccaaatcctgcgcttccttaatgacccctgtcgggtgatgcaagtcatcaagacccgtgatctcagtcatatcaatagataaaagagattgatatacagatttcgcttcatcaaaaaagacatctccattgtgatgtcccggaacatgaaaagaatacgtatttcggtgcgcatgcttcatcagcgctgtatataaaggtgtgtccatttttaaacaaatcctttgcctgtctttcttattatatcgtgcctgcgagccaacttaaagctaagactttttgccatctagccgttatcccggccggaactcatatcaagcagcttcttttttaaatcgccttccatgataacaagctcctcctcggcacgcctgcgtttcatcctgccttcttcttgaatagacatgatttcttcaagtgtgctgactaagctttcctgcacttttttgagggtgtctgcctcaacaagtccgcgctcattggctttggccgtctcgactgtgcttgttttcagaagttcggcgtttttcagcagcaattgatttgtcgtatccgccgccttcttctgcacatctgccgcactccgctgcctcataagcgtcagcgcgatggcgacttgattcttccataaaggaatagccgtaacaatggaggactgaattttctctgccagtgcctgattcgtgttttgaatcagacggatttgcggcgcactctgaagcgtaatctgcctgctcagcagcagatcatgcaccctcttatccagacggtcggcaaactggcgaagatcattcacttcctgtgcggccatttgattgtgttttcgtaattcggcttttcttgccacttcgggaataagctttgttttcagctcatctaattttaattcacccgctgctatatacatagttaaatcagaaaagtattgtttattttggacgtacagctgatctaaccatttattgtcactcaacagcacatttttagaatgttccagccttctgctgatacggtcaatctgcacacttgtcttttgatatttcgaaagcacttcctgcacagatccggatacccttttaaacagccgggcgaaaaaccctttgttctttacctgcagatcatcggggtttacctggtcaagcttcagcatcagatcagccaatatctgtcccatctctcctgcatcttttctttgcacgtgctctatcatcgtgtgggaaaattccagaagattcgcctgcgcctgtgaaccaaacagaacaatgctttgcatgtttccagggtccagtttttcagcgagctgaagtgccgcttctcttttttcttccggcagcgtatctgcaagctttagatgagtctggtcattttgggcgcccatactgtcgtcggaacggtctttggccatttccttcttcctttcttattttctcagtgaatgctttgccatatctaattcaaagtgcaggtcgtcgatgtcctccttcatcagttcatgaagatcttcttccagccttctggaaagctccgccagagtcatcctcgtctcactcaaggacattgataaatctttattttttcgcggctgtgatgagagcaaagcatacttttccgtcagttccacaacagaatcaagcgtttgataatagaaacgctctgcctgataaaaacgcttcggctcctgctttgtgagcagatatattcgtcgggttatccgcagtatctctgcattctgcttcagcatttgtatacttttagagcggaaaagcgccctgcgtaatcggatgattttaccctttgcttcctcgagattttccttgatataagcatattcttttcttgtcagccggtgtttttttaaaaagagacgcttcgcattccacaagccggacgcactgactgcggctccgccggccgccccgtataaaagcgaatacagaaaaggctggtgccctatcgtaaagaaggttatccccgctaatacaaaaactgtgctgccgcaaaatgtccatttcatatattgaataaacggtttcatacttgatcgactcctatttattcacttttatcagtattatctattacattccatgtctaaacaagttcctcttcttatcgtatcagttcttttataaaaagtgaaaaaactcctctgatttcaggcaaaaaaaagacccttttcagggttaagaatataacgtcggtgtatgaaggcttttcaatttacgaacgaaaaattcataattcggatcagaggtcggagtggaaactactttcttctcacactctaaacatataaatttcgtataaatatggattcccctgcttttcttggtttcacacacaatacatgtttcttcatggccggacgtttcattcattttgcccacctccgtatgaatagccttcccttaaactgttgattgtatacacaatttggatctttttgaagtttgcaattagtatatgggcgttcccgtatttcggtgtttgtttcgtttttattcaaaaacaaaaaaggcagctcatgatgagctgcctttaccgtaatgatagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacacgttggtggagcctagcgggatcgaaccgctgacctcctgcgtgcaaagcaggcgctctcccagctgagctaaggccccgtattgggtaaagatggtgggcctgagtggactcgaaccaccgacctcacgcttatcaggcgtgcgctctaaccagctgagctacaggcccatctaccatatgaaagaatcaaaattccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagccttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtgtttgactgactacgcacatcgctgtgcgatttatttaaaactttgaattaacaggtacgttttgtcttgtttagttttcaaagaactttgtccatcgctcttgaagcgacttaattattataacatctcagtgtcattgtcgtcaataactttttaaaatttctttttcaagaattcgtttcgtcatcagcgacgtatattagaataccacccttgatccaacatgtcaacaataatcgacaaattaaatgatgaagcgtttaatgactatcaaagccgcgataccgggaatcccaagaattccgctgatgcccgttgtaatcaggttaacagggatatgaatacccagactgcccccgaacaagttcacacccaccaacagaatcgcgccggcaataaacttaatggcagtcacaccaatccaccttaacggttttgaagatactccccataaaaaaagcaaagcaaccagaccgacaatcaaaccgataatgaaaaaaggctccatgaatcttccccctcgcttgtttagtacaagcttatgagaagattccggagaatagacctcttacttccatctgctcattttcaaattccgctgcttcgcttctttcaaataaaaaaagtacttagattcagcgactttcagctcaaacaacacctcagcggagggctctagacttttctcgaccagactcttctgtctgttccattcttctttttgtttaaagagctgttctatcagcttctcgtcaaactcttttcttaatgtatttctgcgaagaaaacccatgccttgccttttcctcccttacaattcacgtcttccttcaagagcttttgaaagagtgacctcatcagcatattccaaatcaccgccgacgggcagaccgtgggcaatacgggagagcttgatgcctgagggctttaacagccttgatatatacatcgctgttgcttccccttcaatattagggttggttgcgagaataacttctgtcacttgatcatcctgaagacgtttcagcagctccggaatcttaatatcctccggaccgatgccgtccattggtgaaatcgcgccgtgaagaacatgatactggccgttatattccttcattttctccatcgcgatcacatccttagggtcctgcacgacacaaataacagacttatctcttcttgtgtcctcacatatataacaagggtcctgatctgtaatatgtccgcaaatcgagcaatatgtcagattccgcttcgcattgacaagcgccttagcaaaatccaatactgtgtcttctttcatacctagaacaaaaaaagccagacgaaccgctgttttcggtccgatccctggcaatttcataaagctgtcaatcagctttgatattggttcaggatactgcatgtttatttatccccctagaataaacccggtatgttcattccttttgtaaattgtcccattgtctcattcgtcatgtcatccacttttttgagggcgtcgtttgtcgcagcaagaaccaggtcctgaagcatttcgatatcttccggatcaacaacttcttctttaatggcaacgtctacaacttctttttggccgttgacttttacagtcaccataccgccgcccgcagtgccttcaagcactttttcagcaagttcctcctgagccttcgccatatccttttgcattttttgcatttgtttcatcattttttgcatgtttcccattccgccacgcatattcaatcactctctttcatcttattagtcttttatttcgattaaatccgctccgacaagttttttcgcctctgcaatcagcggatcttcttcagccggttcgtttgatccttcactttcctgctggtgatcatttaaaaattcttctcttattttaccccattgtgcttccggaacgccaatcaaatccattcttttcccgagcattgattcgagaatctgttcaagattcgtacggactccgttattgtcttctgcaaccattttacaatggatttcgtatttaaatttaagcacaaatgccttttgagcagcggccaccggttcactgtcattcaaaagagccgcatgagacaccttattctgctgtttcaggtgtgccagcagcttgccccagctgcttttaagctgttcaagatcaggtcttgtggcttccttcaatatctcatgaattcttccgaccggggctttataatggctttttccgcctttttgaggacgcggagcttctttcggagcgctttccatctgaaccttcacaccggaggttttcagcctttctacttcctgctcaagctgctggatcttattcatcagcatgccgacctcagggatgtctccggcggattgctgtgccgtttggcatattttcacgacagccacttcaaaaaagattcttgggtggttcgtccacttcatttcctgatggcttttattcaggatatcaatcatctcatataaagcgggggccggtatgtcaccgctcagattccgaaacgtttcatcgaccttcaccttctccaggactccttctaaaccgggagcggcctggtacaagagcatatccctgaaatagaaaatcatatcttcaatcagtttggccgcatctttcccctgctggagcaattcattcagtgtttccaatgcctcggaaacctgtttgcggtgaagagcagatgccagttttccaatatagtgctgagaaacggctccggtaatgagcaaagcgtcatccaccgacagctcctcgccgctgaatgatacagcttgatcgagcaggctcagcgcgtccctcattcctccgtccgcagcactcgctatgatatcaagggctccttcttccaccttcagctgctctgcatcgacgattgtcttcattcgtccgacaattgctttggatgtaatccgtttgaagtcaaaacgctgacatctggagataatggttaaaggaatcttatgaggctcagtcgtagctaatatgaaaatgcaatgtgccggcggttcttccagcgttttcagaagcgcattgaatgcgccgatagagagcatatgcacctcatctataatatataccttgtaagtaacggccgacggggcaaattttactttgtcacggatgtcgcggatttcgtctacgccgttattcgacgccgcatctatttcaatcacatctgatatagagccatttgtgatccccttgcatgccgcgcactcattgcacggttcttctacaggggcgtgctcacagttgactgctttcgcaaatattttagctgcactggtttttcccgttccccgcggtccagaaaacagatatgcatgagaaaatttcttttgcaaaagggcattttgcagcgttttcgtaatgtgttcctgtccgaccacatcttcaaactgctgaggcctaaatactcgatataaagcttggtaacccacaggatgcgccctcctctgttattcatcatgtttattatacatgaacgtgcttttaacgccaaaacccgtttttcatatacgaaaaaactcacctgccataacaggtgagtctgaaatttgatgattgatttaccgtgcaccttctgtcgattcgctaccctaagcgttacttaagcagttagctcagcccaggcaaccctgcggcacatgagaggtttcacttaatgctgcttccttccggacctgacatggttcatgaattcccattgcgcaggacccagacgtcaacgccacttacttaaggcagaccttacagtaaacgaacctcgagaagggattcggccccgctagagcggattgcgggtacagggcaccgctacctccccgcttagcacggcaaaataaatatcaaattttgatatgcgcaccattcatgatgcacacataagtatatctgcttcaggcagaaaatgcaaccgtactactcagacaactttttcctcatgtctttcttttgccggcgcagctttctgaaaaaagcgctgagcatttctccgcactcttctccgagcacgccgctcaccacttccgcttggtggttgaaccgctcttcctgcaagaggttcatcagcgttcctgtacagccccccttgggatcaaatgcgccgaatacgaccttatcgactctcgaaagcacgacggctcccgcgcacatcggacacggctccaaagtgacatagagaacggcatcctcaagtctccatgtccccagcttacggcacgcttcgtctatcgccagcatttcggcgtgggcaagcgacctctgttcagtctcccgcagattatgcgcccgcgccacgatctcatcgtgcagaacaagaactgctccgatcggcacttcacctttctcttcggctttcttcgcttcttttatggcttctctcatataatattcatcattcatcggttcgagctctcttcttaagttttttcatgtctcataaaggttaaaataggaataccccagcagaaaggagttgccggtattgtctgaacctaacaacacagcccttctgattgtcgatatgatcaacaattttcaatttgatatgggcgaacgtcttgctgaaaaaaccaaacaaattgtcccccgtattttatcattaaagaagcatgcaaaacaaagcaactggccgattatttatattaatgatcattacgggctctggaaggctgatattgatgccatcagggaggaatgcagcaacgacagaagcgcctccattataaaagatatttcgcctcagccggatgattattttctcattaaaccgaagcattccgctttttacgaaacggcgcttcacacccttctgaccgaattacaagtgaaccgattaatcatcacggggattgccgggaacatttgtgtgctgttcacggccaacgacgcttatatgagagaatacagcattgccattccgaaagactgcaccgcttccaataacgacgaagacaatgatttcgctttgaccatgatggagaatgttctcttcgcagaaataaccacggaaaaacaaattaccggcgaaaaataaacatgatcagcctccttttttcatatatttgatagcggatatgaaaggaggcgtttttcattcagatctatatagtgaaacggggcgacacgctttccgctattgcggcgcgctaccggacagccgcaaatgtcattgcggaagcaaataaactgcctaatcccaatacattggttgtcggacaaacccttgtcatcccgattgagggtcaatattacgaagtaaaacaaggtgatactctcgcgtcaatcgccggccgttttcatatatcggccgcggagcttgcgagggtgaacggaattcagcccggcaccacattgagagtcggaacccgcctttacattccgcagcaggcgaataagcccgatatcgaatcaaacgcatatatagaaccgcggggaacgagcgtaagcgctaatcttcagcaggcggcaagggaggcctctccttatttaacatacctcggcgcattcagttttcaagtgcagcggaacgggactttaaaggaaccgcctctgaccaatttaaaaagcatcagtgacaggcacaacaccacactgatgatgatcatcaccaaccttgaaaatgacgcattcagcgatgaactcgggcggctcatcttgaacgacaatacagtgaaaacaaaactctttcaggaaatcgtctccacggctaaaaagtacggctttcgcgatattcactttgatttcgaatatttacgtccacaggacagggaagcctacaatcgttttttacgtgaagcgagaacgatttttcatcgggaaggctggaagatttcaacggcgcttgctccgaaaacgagcgcgactcaggccggcaaatggtacgaagctcatgactatagggcacatggagaaatcgtcgatttcgtcgtgattatgacatatgagtgggggtacagcggaggcccggctgaggccgtatcacctatcggccctgtaagaaatgtcattgagtacgcgctgacggaaatgccttcttcaaaaatcgtcatgggccagaatatgtacggctatgattggacactgcctttcaaacagggaacgacagcgaaagccgtcagtcctcagcaggcaatcgctctggcagcacgctataaagtcgacattcaatatgacgaaaccgcccaggctcccttcttccgatacacggatgcaaatcagagacggcatgaagtatggtttgaagacgcacgatccattcaagcgaaattcaatttaattaaagaacttcatttaagaggaatcagctattggaaactcggcctttctttcccgcaaaactggcttttgctcggcgatcaatttcatattgtaaaagagacgtttcgttaattgggagcgtcttttttcatgggcttttctgtgagtgtgatacaatataaaggccggcagctgacggatgtttgcagaattaaggaggattttcaatgaacagagccccttttatcgcggtagaaggtcctatcggggcaggaaaaacgacactcgctacgatgctttctgaagagctcggttttcctatgattaatgagattgtggaagacaacccttatctcgataagttttatgacaatatcgaggagtggagtttccagcttgaaatgttttttctatgtcacaggtataaacagcttgaagacaccgatcgagattatttaaaacaaggacagcccgttttgtccgattatcatatttataaaaatgttattttcgcagagcgtacattgcacggccaaaagcttgagaagtataagcagatctatcatctgctcactcacgacctgccgaagccgaatatcattgtatacataaaggcaagcctgccgacattgcttcaacgcattgaaaaacgcgggcgcccgtttgagaaaaatatcgaacatcaatatctggaacatctcattgcagattacgacacagccatcagacagcttcaggaagaagatccggatatatctgtactgaccattgacggtgatactgaagactttgttttgaataagacagactatgaaagaattgcccgtcaggtaaaggagcttattaaatgaaagacattcatattccaaacaacgccattataacagtagcgggaacggtaggagtcggaaaatcgactttgaccaaagctttagcaaaacggctcgggtttcatacctcacttgaggaagtggatgaaaacccttatttagagaagttttatcacgattttgaacgctggagcttccatttgcaaatttattttctggctgagcggttcaaagagcaaaaaaacatgtttgaatcaggcggcggattcgtgcaggaccgttcgatttatgaagatacaggcatattcgcaaaaatgcatgccgataaaggaaccatgtcgctgacagattacacaacatacacaagcctatttgaggcgatggtcatgacgccgtatttcccgcatcctgatgttttgatctacttagaaggcgaccttgaatacattataagccggattgaaaagcggggccgcgagatggagctgcagacaaaccgctcttattgggaagagatgtatacacggtacgaagactggatcagcggttttaacgcctgccctgtactgaaagtacgcattgaagattatgaccttgaagctgatgaacagtcactggaacctttgatcgaaaaaatcagtcacgtgatcagcgaaaacagaaacaaataaaaatagcaaagcgattttccccgaacagagaaaatcgctttttttgcatataaaaaatccgctgcatcagatgcagcggacaaaacaatctccaatatatgctcgagtttcattaggtttaaaatcaatatggcggaggaagagggattcgaacccccgcgggctttgacacccctgtcggttttcaagaccgatcccttcagccagacttgggtattcctccgtatcgacatttaataatataccacatgacccaaatttcagtcaagcgctttttcatattttttatttcatttcttaaacagcttttccgtcagctttactatcatacaaaagtcttgcgtccaattcaacctcagtatgccatacgggcaggaaaacaaagtaaaaatcaagaatagattcaaacagataacctgctcataaaggtggagaacataatgaaaatcatcatcgcacccgattctttcaaagaaagcatgacatcaaaagaagccgctgacagcatagaaaaaggattcaaagcggtcttccctgacgcggaatataccaagatacccgcggccgacggcggagaaggaaccgttcaggctttgacggatgccactggcggaagcatcatcaaaaaaactgtgaccggtccgctgggaacgccggtaaacgccgcatatggacttctgggagacggacgcacggcagtcattgaaatggcggaagcatcgggactccatctcgttccccgccatctcagagatccgttgaacacaacgacaagaggaacgggtgaactgatagcggatgcagcctcccgcggggcgagtgagatcatcatcgggcttggcgggagtgcaaccaatgacggcggaacaggaatggcgagcgcgctcggtgtgcgtttcttaaatgaggaaggtcaggagatacatgacggaggaggcgctctgcacaccctagcttctattgatataagcgggctctcccctgatctgaaacatatccgttttcgtgccgcatgtgatgtcgaaaatcccctgaccggtgaaaacggcgcgtcatatgtcttcggcccgcaaaaaggggcgtccgagaagactaaagttgtattggatcgcaatttataccatttcgctgacgtattgagacgtcagcacgatatcgaagcggataccgtaaaaggcgcgggcgccgcaggggggctgggcgctggactgatcgctttcttacaggcagaaattcaaagcgggattgacgttgtattagatacactgtccttctcagatcagataagagatgctgaccttgtcattaccggagagggccagattgacggacaaacgatattcggcaaaacccccgccgggatcgccgcacgcgcagccgctcaagaaattcccgttatcgcattggcgggctccttaggcaaaaattttgagcatgtttacagcgcaggaataacagctgtattttctatcgtgcccggcgctgtaagtcttgaagacgccttagcatccggccgttttaacctggaaagtacagcccggaatgccgccgctctataccgggcagcaaaaaaggcgcgcctctagggcgcacctttttatggtttgatgacttctttatttcccatataaggacgaagcactttaggaatgatgacacttccgtcttcctgctggtagttttccaagatggcagctacagttctgccgactgcaagacctgaaccgtttaatgtatgcacatgctcaggcttgcctttcgcttcgcgtctgaaacgaatgttcgcacgtcttgcctggaaggcctcaaagttgctgcaagaagaaatttcacggtatgtgtcttggcttggaatccatacctcaatatcgtactttttcgcagctgtaaagccgagatcaccggtacacatgctcatgacgcgatacggcagttcaagcagctgaagcacccgctcagcttgatttgtcagtttttcaagctcctcataagaatcttccggcttcacgaactttacaagctcaaccttgttgaactgatgctgacggatcaaaccgcgtgtatcacggccggcggatcccgcttctgaacggaagcaggcgctgaacgcggcataattgatcggcaggttctcaccggataagatttcatcgcggtgcatatttgtaatcggcacttccgccgtcggaattaagaaataatcctcttctctgattttaaaagcatcctcttcaaatttaggaagctgtcccgtacctgtcatgctcgtacggtttaccatataaggaggaatgacttccgtgtaatcatattcatccacgtgaagatccagcataaagttgtagagcgcgcgttcgaggcgggcgcctaatcctttataaaacacaaaccggctgcctgttacttttgaagcgcgttcgaaatcaagaatgtttaagcggtctgcgatatcccaatgcggtttcggctcatatgaaaatgccggcgcctctccccacttgcgaatttcaatgttatcatcttccgtttctccgacgggaactgaatcgtgcgggatgttcggaatagacagaaggatggtttcgagcgtcgtttcgacagtacgaagctcttcatcaagcttcttaatttcttcgcctacttcacgcatctctttaataatatgatcagcgtcttttttctcccgtttcaaaacggcgacctgctgagacacctcattgcgttttcccttcagttcttctactttaccgataagctctcttctcttttcatccagctcttcaaacttgtcaaagtcagataagtcttcgccttttggaatgagcttcgcttttacctcttgaaaattggctctcagcaccttcgtatcaatcatgcctaacaactcctatctgtttttatcgaaaataaaaaagagccctcatcccctaaaagggacgagagctctcgcgttgccaccctgattgaaaacaagctcacacttgctttccgctttaacacataacggttttcccgtaaatgcctacttgttttcagcatttcgctcaaggacggattcggacagcatctttcaccgattcgcaccacccatcggctctctttgaaagaggggcttcctactgcttcctgtcaacgcttttcgatctttatttgtgattataatgtactataagtatcagcggttttcaactgttttatacagctgtttcctgcttatgcttttccgccatcttcacaaacagctctgtcacccggtgatcatccgtcagttcaggatggaacgagcagccgaggaaatttccctgctttgcagccacgatgcgtccgttatgctcacaaagcacttcaacatcttctccggcttttaaaatatgcggtgcgcgaataaatacacccgtaaacggctcatcaaggcctttaatcgtcagatcagcttcaaagctgtcgacctgacggccaaaggaattacgctcgacaactacgttcaacagccctaaatgagcgttatccgttcccgctatctctttggctaagataatcagaccggcgcatgtgccgaacatcggcttgccttgagcggcaaactcgcgaagcggctccataaaatgatacgtatccattaaacgccgcatcgtcgtgctttccccgcccggcaggattaagccgtcgatgtcattcagctgttcaggacgcttaatgacgacaccttttgaaccacatgcttcaattgaacgaatatgttctcttactgctccttgaagtccaagtacaccaattgttaacatgcttacagctctcctatggttttaccagccgcgttcttgcatacgctgttccggcaatagatttgagatttcgatgcctttcattgctgtgcctaattctttagaaagctcagcgatcagtttgtagtctgtataatgagtcgttgcttcaacaattgctttggcgaatttagcagggttgtctgatttgaaaatacctgaaccgacaaatacgccgtcagcgccaagctgcatcatcaatgccgcgtcagcaggcgtcgctactccgccggcagcaaagttcactacaggcagtttgccgtcacgtttgatctgaagaagcagttcataaggagcgccgaggtttttagcttcagtcatcagctcatcatcgctcatcgcaacaactttgcgcacttgcgcgtttacttttctcatatggcggacagcttccacaatgtttcctgttcccggttcgccttttgtacgaagcatggaagctccttcggcgatacggcgcgttgcttcgccgagatcacggcagccgcatacgaacgggactgtatattcatttttatttaaatgaaattcttcgtcagccggagtcagaacttcactttcatcgatgtaatctactcccattgcttcaaggacacgcgcttcaacgatatgtccgatacgcgcttttgccattacgggaatggatacagcattcattacttcttcaacgattgtcggatcagccatgcgggcaacaccgccggcagcgcgaatatcagccggaacgcgttctaacgccattacggcaacagctcccgcctcttccgcaatcttcgcttgttcagcatttactacgtccatgatgacgccgcctttttgcatttccgccatgccgcgttttacacgatcagtacctgtttgagccattatttggtccccctagtcaatgtatagttagataatgtctatctcttattgtatcccagaaatacaatatttcatatgggtattcttattttacagcgagatgaataagatagatatcatttttttactaataatttggttttttcagtatattaagcaaaagagccctaactttcatcagagctctttcttatttcttaaaaccagcctgttaccgtgtcaacggcgctgttccagataccggagaaaaatccgccgatgccgcgcatcatctgaacaaaccagtttgctttatctacatcatttttcgttacaagattcacgctgaactctttggatttgaggaagccatagtctttgtcactgcctttgtatgtaactgtcagcgttccgactttcgttccctttttcacaggagccgtgatttcttttttatctatagtcccttcggctttatagttcttttcatccccgcttttcacaggaatagaaagcgccttgtcagtaacaatatcgacttgcttgtctttccctttttcaacgtcaaccgttttgtgcccttttacttgagagccttcagggtaaagatctttcattgagaaattgctgttaaatgcgtaatcgagcatttttttcgtttcatcaaaacgtccggtatgcaggttgccttttgcgtttaatacaacggtgatgacccgcattccgttccgctgtgctgtgcttgtaaaacaagatcccgcagaatcagtagaacccgtttttaagccgtcaacgccagggtattcagaaacaagaccttttaacatgaagttccagttcggcatgtccatttcatcatcagtgccggctctgaatttcgttttagcgatgcttgttgttttgagaacttccggataatcagtgatcaggcggtctgcaagaagcgccatgtctttagcagaaacttcactctcttctttaacgccttctccttgcggctgtttgccgtgaagatcttcattcacaagccctgtggcatttttaaaatcatagtttgtcatgcctaattctttggctttcgcattcatttcagcgacaaatttcgtttcagttccggcaagaatttcggcaactgcaatcgcggctccgttagcagagtaaatcgccatggcctgatacagttctttaaccgtgtatttgccgtcttttcgaagggggacgtttgataaactgttgtcttgagaaatttcatagacataatcatcaggagtatacgtttgatcccatttcacttttccttctttaatggcttccagaagcagatattcagtcatcatttttgtcatgctggcaatcggcagtcttttgtctgcatttttactgtataaaatttttcccgatgaagcctcaatcattatcgcagctgatgcgttgacatcaatcgggtcattgccggctgcctccgctttagacatcggaacaaagcaagttgcggccagtgccagtaccactaatgacaccaacagctgtttccatttcgtgatgttcaatcttacgacctccgtcattcattttaaatctataattaagccgttaaggacatattcaaattcaaaacacaacagtataaattttatcacactcgatataaaaaaaatagacagagtcagcgaccctgtcaaatgttttttatttgtaacaattatgagattgtgtagtttggtgattctttcgtaatttggacatcatgcggatgactttcgcgaagaccggcacctgtcatacggatgaattgagcctcttctcttaaagcgcgcaagtcttttgaaccgcaatatcccatacctgaacgaagaccgccgacaagctgatacactgtttcttctacaggacctttgtacggagtccgtccttcgataccttcagggacgaatttcttattttcttcttggaaatatcggtctttactgcctttttccatggcagcaacagaacccataccgcgatacactttaaatcttctgccctgatagatttcagtctctcccgggctttctgaagtaccggcaagcaggcttccgagcattacggcatgtccgcctgaagccaacgctttcgtaatatctccggagaatttaataccgccgtctgcgataattgtcgcgccgtgttttctcgcttcagtggcacaatcataaatggcagtgatctgcggtacgcctacacctgcaacgacgcgtgtcgtacagatagaaccaggcccgattcccactttgacaatatttgctccggcttcaatcagagcttttgtcgcttcagccgttgcaacatttcctgcgataatgttcagttcaggatatgtttcacggattttcgcaactgtgttcagtacgcctctggaatgtccgtgagccgtatcaaccacgataacgtcgacattcgcttcaacaagcttgctgacgcgtgtcattgtatcgcctgtcacgcctaccgcagcgccgacaataaggcgtccgtgttcatctttagatgaattagggaattcgataaccttttcaatatctttgatcgtgataagaccttttaatttgttttggtcatccactaacggaagtttttcaattttatgtttctgtaagattttttctgcttcgtctaatgtggttcccacaggagccgtaaccagctcttcttttgtcatgacatcactgattttcattgaataatcagagataaagcgaagatcacggtttgtaatgataccgacaagcttttgatcgtctttattatctacgatcggaacaccggaaattctgtatttccccatcaaatgctccgcatcgaatacttgatgatcaggtgttaaaaagaagggatttgtaataacgccccgttcagaacgtttgactttgtcaacatgttcagcctgctgttcgatggacatgtttttatggataatgcccaagccgccctgtctggccatcgcaatcgccattgctgattctgttactgtatccattcccgcactgatgacaggaatattaagctttaacgtttttgtcagttcaacagataaatccacatcacgcggaagtacgtctgattgagccggtacgagcagtacatcatcgaacgttaagccttcttttgaaaatttactttcccacattagtaaatccccctcttttcggcaaaatattatatgtagattatcaactagaaaacagcatgtcaaggaagcgaaaaagagttgaaatatttagataaaggaaagggtttaaaaatacatatgagagatcatgagtggaaagagttatcattattttattccgtagaatcttcccagaaatttctaaacaaagtctatacagaaagcggcatggaagaaccaaaacgatatgcgtttaagaacagtgagcgcttcatattctttatcaaacacgccgagtccttttataagcaggcatctctttctcctttagaaattaagcctattctgttgttttacgggatgtcacaattgctgaaagcctgccttctgaccacagatccaagctacccaagccacgcttcagtactcgcgcatggcgtgactgcccggaaacgcaaaaagcaaaattactcctttagggatgatgaagtgaaggtgcagcgcaatggcttatgtattcatgtaatgaagcacttattcgggatagctggtcttgaggaagaacggtacacaatgaagaaattactgacagccatacctgaattgcatactgtcttttacttccaagagaaaaagaattggatgacccaagtagagctgaacgatgaccttatttcagtgcctgagcatgcggtgattcattacaatatgtctgattcccgctttgctgaatatatcagccatcatttgaagtggtcttttctgaggaaagaccataaccacttgttttttgaggctgacccgatagacagggaaccttggtcttctccaaatttattgtttcacttggagaaaaatcaatattacattccctctcagcgtgatcacttcctgcatcttccggaaatgattattcattatttggttctctacaatattgggatgattgcgagatatgaaacggagtggtggtatgaactgctgacacagcatgtcagtgatgattatgtgatgatccgacggttcttagaggtcacggaacgcaaatttccgtattacgtttctaaattcctgaagcaatacttgtaaacaaaaaaggcagctcatgatgagctgcctttaccgtaatgatagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacaataagtatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacacgttggtggagcctagcgggatcgaaccgctgacctcctgcgtgcaaagcaggcgctctcccagctgagctaaggccccgtattgggtaaagatggtgggcctgagtggactcgaaccaccgacctcacgcttatcaggcgtgcgctctaaccagctgagctacaggcccatctaccatatgaaagaatcaaagttccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcaaacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagaacttttccgcccctctcgaagcgacctcttaatcataacattttcagtttgctaggtcaatacttttttaaaaaatattttcgctaggcttgcctttctattaaaaagacaacaaaaagaattatatcagcatcatcaccatgtgtcaaagcttttttttatttctttatatagtaaaagcgcagcctgttgcagctgcgctttttcgtttatacttcttccgtttcttccggctcttcttcattcttttcgacaagcgccacagtggctacatgctcttgatcagacatgcggatcagacggacgccttgtgttacgcgtcccgtagtggagatatcattaatatccattctgattaacacgccgcttgccgtaataatcattaagtcctcttcgccttttgttgctttcacagttactaacggaccgttgctgtcagtgattttacatgttttaaggccttttccgccccggctttgaactctgtattctgaagccggtgtgcgtttgccgtagccgttttctgtcactatgaggacatgggagtcttcttcaagaatctccatgcctacaacgacatcatcgtctgtcagcgtgatacctttaacacccgcagctgtgcgtcccatttgtcttacatcttcttcagggaaacggatcagcaaaccgttcttcgttccgatgatgatttgtttcttgccgtcagtcaggcggacggccatcagttcatcgtcttcccggagacctagggcgatcagaccgttattccgtatattcgcaaactgggacagtgccgtacgtttcgacaccccttgtttggtcgtaaagaagaggtattgctcctcatcaaacgtgctgaccggaataatggcattaatccattcgcctttttcaacttccagaaggttaataatcggaatgccttttgccgtacggccgtattcagggatttcatatcctttagaacggtataccttccctttattagagaagaacagaatcgtatcgtgcgttgatgtggaaattaagtgttccacaaagtcatcttcattcgttcccattccctgtacgccttttccgccccgtttttggctgcggtatgtggacgccgggagacgtttaacatagccgttatgggtcagtgtgatgacgatattttctctctcgataagatcttcatcttcaattgtttcaagaccggacgtcacgatttcagtgcgtctctcatcattgaaacgctctttgatttcattaagttcttcacggatgatctcaagaactctttcttcattggctaaaatatctttcagctcagcgataagcgcaacaagtgattgatattcctcttcaatcttttcgcgctccagaccggttaatcgctgaaggcgcatatccagaatagcttgcgcttgtttttcagtcagtgagaattgttcgatcaaacccgttctcgcaatttcagccgtctgggaattgcggataagagaaataacggcatctaaatgatcgagagcaattcttaaaccttccagaatgtgagctcttgcttccgctttgcggagttcgtaagccgttctgcgccggatcacaaccttttggtgatcaagataatgctccagacattgtttcaggcttagtaccttcggctgtccgtcaacgagcgccagcagattgattccgaaagacgtctgcagggccgtttgtttgtacaggttattcaaaatgacgtgagcattggcgtcacggcggatctcaatgacgattctcattccgttacggtcggattcgtctcgcagatcggtaattccttcgatttttttgtctcggacaagatccgcgattttttcaattaatctcgctttgttcacctgataaggaagttccgtgacaataattctttcttttcccgatgaagtctcttcgatttcagccttagcccggatcgtgattgatccccgtccggattcatatgccttgcggatgccgctccggcccaaaatctgacctgcagtcggaaaatccgggcccgggatgtattccatcagctcctggtttgtaatctcaggattctcacttacggcaagcacgccttcaatgacttccccaagctgatgcgggggaatgtttgtcgccattccgaccgcaataccggcagccccgtttacgagcagattcggaaatctcgaaggcatgacggcaggctctctttctgaaccgtcatagttatcttgatagtcaatcgtgtctttcgtaatgtcacgcagaatttccattgcgatttttgacattctcgcttctgtgtaacgcatcgcggccgctgagtcgccgtcaaccgaaccgaagttgccgtgtccgtcaacaagcatgtagcggtagttaaaatcctgcgccattctgaccattgattcgtaaaccgctgagtcaccgtgcgggtggtacttaccgataacttcaccgacgatacgggcagattttttatatggtttgtcactggtcatgcctaaatcattcattgcgtacaaaatccgtctgtgaaccggcttcagaccgtcacgcacatccggaagcgcccgggatacgataacgctcattgcatagtccaggaaggatgtccgcatttcctgactgatattgacttcacgtacttgtggtgtgttttgttcactcattaaaaaaacctccctgaagtatcacatgaaataatgtgggagtagattgtccattatgatcttcaatacgatttcactattctccattatatcaataaacttgtgtttatacacattaatttagtagaatatacgggttttgcgggttttcagaggctttagaagccgctttgagaaaaaagccttatttcttaacgaaaataaggctttcttggttaaatatcaagatttttcacgtatctggcgtttgcttctatgaagtttctccgcggttctactttgtcacccatcagcatttcaaaagtctcgtcagcgtccattgcatcttcaagattgacttgcagaagcgttctggtcgcagggtccattgtcgtttcccaaagctgagtcgcgttcatttctccaagacctttataacgctggaggccgggcttaggtgattgcggaagctcttttaacagctcatcaagctgcttatcgttataagcgtattccacccgttttccctgctgcactttataaagcggcggctgggcaatgtagacatagccgttttcgatgatttcccgcatgtatctgtagaagaacgttaataaaagcgttctgatatgggcgccgtcaacatcggcatccgtcatgatgaccactttatgataacgcgctttttcaagattaaaatcttctccgattcctgttccgagggccgtgatcattgatctgacctcattgtttgagagaatcttatcaagtctggctttctcaacgttcagaatcttaccgcgcagcggcagaatggcttggaaatgacggtcccgtccctgtttcgctgatccgcccgcagagtcaccctctacgatatacagctcggaaatgctcggatctttagaagaacagtccgccagtttgcccggcagattggaaatctcaagcgcacttttgcgccgggtcaattcccgggcttttttcgccgccatccgcgctcttgcggccattaaacctttttcaacgattttgcgggctgagtccggattttcaagaaggaatgtttccagcgcagaagaaaacagcgtatcagtgatcgttctcgcttcggagttgccgagcttggttttcgtctgcccttcgaattgcggatcagggtgcttaattgaaataatggcagtcagcccttctctcacatcatccccgcttaaattcggatcattttctttgaaaatcccttttcttcttgcatagtcgtttatgacacgggtcagaccggttttaaatccggcctcgtgcgtgccgccttcgtatgtgttgatattatttgtgaaagaataaatattgcttgtatagctgtcgttgtattgcaatgcaacttcaaccgttatgccgtctttctcgccttcgatataaatcggctcttcatgaacgacttctttggaacggtttaagtactcaacatagcttttgattccgccttcgtagtggtactcgtttttccgttcttgtccttcacgtttgtcttcaatcgtgatgtttacgccttttgtcaggaaggccaattcccggacacggtttgaaagcagatcatagtcatatacagttgtttctttgaaaatttccgggtccggaacgaagtgcgtaatcgttccggtcttatcagtttcgccgatcacttcaagatcggccacaggtacaccgcgctcgtacgcctgataatggatttttccgtcacgatgaaccgtaacgtcaagagtggtcgacaaggcgtttacgacggatgcccctacaccgtgaagaccgccggatactttatatccgcttccgtcaaatttaccgccggcgtggagaacggtcatgatgacttcaaccgcagggcggcccatcttctcctggataccgaccggaattccgcgcccgttgtccttaacggtaatgctgttatctttttcaatctcgatgttaatatctgtacaataaccggccagggcttcgtcaatactgttgtcgacgatttcccacaccaaatggtgaaggcctttgctgttagttgatccgatgtacatccccggtctctttcgaacagcttccaaaccttctaatacctgtatctgattctcatcataactattttgctgctgttccatagccatgcacattcacctacacttttcttaaacgataatatattcattgtaaagatccgctaagaatctatttctaacataaattgcgcacgtttcttcagtgtgccggaagataagggagagtaatatatattctcagtcgtgactacgatagactttggcgtgccgtttacggacggcactactttttctttctgtctgtccagaaattcttcaacgatcggcgatacattgaccttgcagtcaaaaatgccgacgatatcgcgggttgaaacgacaaagtcgtcacctaaatgaatatacaatcgctcacctcatttcttcacttcactaacgcaccgttttccacacggaacattcctgcttgatgtaaggtatcgtggtcaatgccatccacgctcgtcgtggtgacaaatgtctgcacacggccttggatcgtatgaagcaaatgggactgtcggtaatcatccagctcgcttagtacatcatccaaaagtaaaatggggtattctccgatttcttcatgaatcaaatctatttcagccagctttagagacaaagccgtcgtacgctgctgtccctgcgaaccgtaagtctgcacatcgcgtccgttcacataaaaaaggacatcatcccgatgcggtccgaataatgtgacgcctcgttctatttctttttcttttaatttcgaaaaagactcctggtagctgttacctattttcgacaaatctttgggatctgatacatcaagcgccgtgtgatacttaagcgtcagttcttcaagtccccgggaaatgccggaatggatcggctgcgcccatttttcaagctgcgccgtaaactgcagacgtctggcgacaacttttgcggctgcttcaatcagctgatcagtgagaacgtcaagcatggtccggtcagtctgtttccggctttgcagctgtttcagaaaatgattccgctgtgaaaggattttttgataaagagataaatcatacagataaacggcagaaacctgcccgatctccatatcgagaaatcttctcctcacctgagggcttcctttgacgagatttaaatcctcaggggcaaacataatggtgttcagcgctccgacatactgactgagtttttgctgctctatatgattgaccttgccctttttaccttttttggagatgacaagctgcatcgggatgtccccgttgcgcttcatcactcttccttctattttagcatagtcttcgtcccaccgtataagttctttgtcatttgaggtgcggtgtgattttgccatcgaaaggacatagatggcttccatcagattggttttgccctgggcattttccccgatgatcacattcaccttgttttcgaattgaagctcagcgcgctcataattacggtaggatgttaattctaaattttggatatacaaccgctgtcacccgctttaattgacgacttgaaatgaaccaaatccttcaatcgcgaccacgtctccaacgtaaagctttctgccgcggcgattgtcaggttcattgttgacagtcacctcatgctcgctcagaaaccacttcgccatgccgccggactgaatcacatcagctaattttaaaaactggccaagcgtaatcatttctgtatcaatcgaaatcggatttgccataatatcgacctctttcaaatatcactaatatctaattgtactaaaaaatcctgaaataaggaaagggaaaacttgagggagcggctgatgaatagaaaagctgccgaactaagccggcagcacattctgtttgattaatacgttctgaccggaaggatgagctgaacgatggtctcatcattcggcgtacggataagaaacggtctcatcgctcccgtaaagctgatacggatgtccgctccttcaagtactttcagtgcgtccatcatatattttggactgaatgaaatatttaattcctcgccgtcaatcttgtctgccagcacagcttcgaccactttcccgatttccggagaatttgatgaaatctcaagcgaatccgccggtttggcagaaagttttacaacgttgttgcggccttctctcgccaataaagaagcacggtctatcgcctgtaaaaattccttcgtgttcacgacgatttccgttttgctttcctgcggaattaagctggtcgtgtccggatagtttccgtcaagcaatcttgagaagaacaatacgtttttcgctttgaacagaacttgggtttctgtaatgacgatatccaccagctcttggctgtcatcaagaattttgcttagctcggttaagcttttcccgggaatgaccacgttataagtactgtcttccggaatatcaagcttcgcctttcttaaagcgagtcggtggctatccgtggcagtgcataataattcaccgttttcaactttccagtttacacctgtcaagatggggcgtgtttctgaggcggacacagcgaacacggtttggcggatcaggtttttcaaaagatccgtcggaatctgaatggcgtgatgctcttcgatttgcggtagatgcggatattcatctgcatcaaggccgtttaaattaaattcggcttttccggaacggataatcgttaaatattgattttgaacttcgatttcaacagtcgccatcggcagttttttaacgatttcgctgaagaaacgcgcttgcagcacgatacttcccggctgatcgatcgtcacgatttctttatcatcatcttctttcggaatgaatgactcaattgaaatatcagagtcacttcctgtgaaagatactccttcatctgaggcgacgatcttaataccggtgagaatgggaattgtggttctggatgaaacggcttttagaacgtcttgtacactttcgactaaccgatctttttgaatcgtaaatttcatgtttatcctcctaacggataatataattaatatatttttaaaaatagcagtagtaatagtagggcctgtggatttgtggataagttgtgaaaaagacaggaaacacagcctatccacatgtggacagactgtgtatggctatgaaaaagttattcacactttccccgattcatccgaggacactattatttaagcagttcttttatttctttcacctgctgctgaagctgctcgtcatcaatcagcagttttgaaatcttttcgtgggcgtgaatgacggttgtatggtctctcccgccaaattcttccccgattttaggcaaagaagaatccgtcatttctcttgaaa
